United States Patent
O'Connor et al.

(10) Patent No.: US 12,497,629 B2
(45) Date of Patent: Dec. 16, 2025

(54) METHODS FOR CONTROLLING MERISTEM SIZE FOR CROP IMPROVEMENT

(71) Applicant: Pairwise Plants Services, Inc., Durham, NC (US)

(72) Inventors: Devin O'Connor, Hillsborough, NC (US); Nathaniel Graham, Durham, NC (US)

(73) Assignee: Pairwise Plants Services, Inc., Durham, NC (US)

( * ) Notice: Subject to any disclaimer, the term of this patent is extended or adjusted under 35 U.S.C. 154(b) by 870 days.

(21) Appl. No.: 17/350,187

(22) Filed: Jun. 17, 2021

(65) Prior Publication Data

US 2021/0395767 A1     Dec. 23, 2021

Related U.S. Application Data

(60) Provisional application No. 63/040,044, filed on Jun. 17, 2020.

(51) Int. Cl.
*C12N 15/82* (2006.01)
*C12N 9/22* (2006.01)
*C12N 15/11* (2006.01)

(52) U.S. Cl.
CPC ........... *C12N 15/8262* (2013.01); *C12N 9/22* (2013.01); *C12N 15/11* (2013.01); *C12N 15/8213* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | | |
|---|---|---|---|
| 10,876,129 | B2 | 12/2020 | Pennell et al. |
| 2019/0032071 | A1 | 1/2019 | Pennell et al. |
| 2020/0377900 | A1 | 12/2020 | Cargill et al. |

FOREIGN PATENT DOCUMENTS

| | | |
|---|---|---|
| CN | 103088054 A | 5/2013 |
| CN | 108192912 A | 6/2018 |
| WO | 0170987 A2 | 9/2001 |
| WO | 03093450 A2 | 11/2003 |
| WO | 2008062049 A1 | 5/2008 |
| WO | 2013138544 A1 | 9/2013 |
| WO | 2017139309 A1 | 8/2017 |
| WO | 2020023258 A1 | 1/2020 |
| WO | 2021195458 A1 | 9/2021 |

OTHER PUBLICATIONS

Clark et al 1997, Cell 89: 575-585 (Year: 1997).*
Genbank 1997 Accession U96879 (Clark et al 1997) https://www.ncbi.nlm.nih.gov/nuccore/U96879 (Year: 1997).*
Guo et al, 2004, Proc. Natl. Acad. Sci. USA 101: 9205-9210 (Year: 2004).*
Man et al 2020, New Phytologist 226: 1492-1505 (Year: 2020).*
FEA2_Maize, version 102, UniProtKB Accession No. Q940E8 (B4G061); dated Feb. 13, 2019.
International Search Report and Written Opinion corresponding to International Application No. PCT/US2021/024283; dated Jul. 16, 2021, 13 pages.
International Search Report and Written Opinion corresponding to International Application No. PCT/US2021/027609 dated Sep. 28, 2021, 22 pages.
International Search Report and Written Opinion corresponding to International Application No. PCT/US2021/035114, mailed Sep. 21, 2021, 14 pages.
International Search Report and Written Opinion corresponding to International Application No. PCT/US2023/069210, mailed Oct. 16, 2023, 21 pages.
International Search Report and Written Opinion corresponding to International Application No. PCT/US2023/069211, mailed Oct. 16, 2023, 21 pages.
Leucine-rich repeat receptor-like protein fasciatef ear2, Uniprot Database Accession No. Q940E8 (Dec. 1, 2001).
Receptor-like protein kinase 5 [*Zea mays*], EMBL/GenBank Accession No. ONM34918.1 (2017).
Fon2-like cle protein1 [*Zea mays*], Retrieved from https://www.ncbi.nlm.nih.gov/protein/ONM16738.1?report=genbank&log$=protalign&blast_rank=1&RID=BF2FPXGG013 on Jul. 19, 2023.
Hypothetical protein ZEAMMB73_Zm00001d007576 [*Zea mays*], Retrieved from https://www.ncbi.nlm.nih.gov/protein/ONM27114.1?report=genbank&log$=protalign&blast_rank=1&RID=BHMXAB2Y016 on Jul. 20, 2023, 2023.
*Zea mays* clone 462207 mRNA sequence, Retrieved from https://www.ncbi.nlm.nih.gov/nucleotide/EU974983.1?report=genbank&log$=nuclalign&blast_rank=2&RID=BF1RUX1A013 on Jul. 19, 2023, 2023.
Bleckmann, et al., "Stem Cell Signaling in Arabidopsis Requires CRN to Localize CLV2 to the Plasma Membrane", Plant Physiology, 152:166-176 2010.
Bommert, Peter, et al., "Quantitative variation in maize kernel row number is controlled by the Fasciated EAR2 locus", Nature Genetics 45(3), 2013, 334-337.
Crook, Ashley D., et al., "The systemic nodule number regulation kinase SUNN in Medicago truncatula interacts with MtCLV2 and MtCRN", The Plant Journal 88, 2016, 108-119.
Czyzewicz, Nathan, et al., "Antagonistic peptide technology for functional dissection of CLE peptides revisited", Journal of Experimental Botany 66, 2015, 5367-5374.

(Continued)

*Primary Examiner* — Shubo Zhou
*Assistant Examiner* — Aleksandar Radosavljevic
(74) *Attorney, Agent, or Firm* — Myers Bigel, P.A.

(57) ABSTRACT

This invention relates to compositions and methods for modifying a Leucine Rich Repeat Receptor Like Protein Kinase (LRR-RLK) gene in plants to increase kernel row number. The invention further relates to plants having increased kernel row number produced using the methods and compositions of the invention.

4 Claims, 4 Drawing Sheets

Specification includes a Sequence Listing.

(56) References Cited

OTHER PUBLICATIONS

Ellison, Erika L., et al., "Mutator transposon insertions within maize genes often provide a novel outward reading promoter", bioRxiv. https://doi.org/10.1101/2023.06.05.543741, 2023, 1-33.

Fan, C., et al., "A Novel Single-Nucleotide Mutation in a Clavata3 Gene Homolog Controls a Multilocular Silique Trait in *Brassica rapa* L", Mol Plant 7, 2014, 1788-1792.

Goad, David M., et al., "Comprehensive identification and clustering of CLV3/ESR-related (CLE) genes in plants finds groups with potentially shared function", New Phytologist 216, 2017, 605-616.

Guo, Y., et al., "Clavata2 forms a distinct CLE-binding receptor complex regulating *Arabidopsis* stem cell specification", Plant J 63: 889-900, 2010.

Je, Byoung Il, et al., "Signaling from maize organ primordia via Fasciated EAR3 regulates stem cell proliferation and yield traits", Nature Genetics 48, 2016, 785-791.

Je, B., et al., "The Clavata receptor Fasciated EAR2 responds to distinct CLE peptides by signaling through two downstream effectors", eLife 7: e35673.

Laux, Thomas, et al., "the Wuschel gene is required for shoot and floral meristem integrity in *Arabidopsis*", Development (Cambridge, England) 122, 1996, 87-96.

Li, Manfei, et al., "Genetic and Molecular Mechanisms of Quantitative Trait Loci Controlling Maize Inflorescence Architecture", 2018 Plant Cell Physiology 59 (3), 2018, 448-457.

Liu, Lei, et al., "Enhancing grain-yield-related traits by CRISPR-Cas9 promoter editing of maize CLE genes", Nature plants, 7(3), 2021, 287-294.

Miwa, H., "The Receptor-Like Kinase SOL2 Mediates CLE Signaling in *Arabidopsis*", Plant Cell Physiol 49: 1752-1757, 2008.

Muller, R., et al., "The Receptor Kinase CORYNE of *Arabidopsis* Transmits the Stem Cell-Limiting Signal CLAVATA3 Independently of CLAVATA1", The Plant Cell Online 20: 934-946, 2008.

Nimchuk, Z.L., et al., "An Evolutionarily Conserved Pseudokinase Mediates Stem Cell Production in Plants", Plant Cell 23: 851-854, 2011.

Nowak, Stephen, et al., "The Medicago truncatula CLAVATA3-LIKE CLE12/13 signaling peptides regulate nodule number depending on the CORYNE but not the Compact Root ARCHITECTURE2 receptor", Plant Signaling & Behavior. vol. 14, No. 6, 2019, e1598730.

Rodriguez-Leal, Daniel, et al., "Evolution of buffering in a genetic circuit controlling plant stem cell proliferation", Nature Genetics. 51, 2019, 786-792.

Rodriguez-Villalon, Antia, et al., "Molecular genetic framework for protophloem formation", Proceedings of the National Academy of Sciences 111, 2014, 11551-11556.

Schoof, Heiko, et al., "The Stem Cell Population of *Arabidopsis* Shoot Meristems Is Maintained by a Regulatory Loop between the Clavata and Wuschel Genes", Cell 100(6), 2000, 635-644.

Somssich, Marc, "On Receptor Kinase Interactions and Complex Formations", Inaugural dissertation zur Erlangung des Doktorgrades der Mathematisch-Naturwissenschaftlichen Fakultat der Heinrich-Heine-Universitat Düsseldorf vorgelegt van Nov. 18, 2014 Dissertation.

Somssich, Marc, et al., "Shared and distinct functions of the pseudokinase Coryne (CRN) in shoot and root stem cell maintenance of *Arabidopsis*", Journal of Experimental Botany, vol. 67, No. 16, 20116, 4901-4915.

Song, Xiu-Fen, et al., "Antagonistic Peptide Technology for Functional Dissection of CLV3/ESR Genes in *Arabidopsis*", Plant Physiol 161, 2013, 1076-1085.

Song, Xiu-Fen, et al., "Contributions of Individual Amino Acid Residues to the Endogenous CLV3 Function in Shoot Apical Meristem Maintenance in *Arabidopsis*", Mol Plant 5, 2012, 515-523.

Taguchi-Shiobara, Fumio, et al., "The fasciated ear2 gene encodes a leucine-rich repeat receptor-like protein that regulates shoot meristem proliferation in maize", Genes & Development, 2001, 2755-2766.

Tran, Quan Hong, et al., "Mapping-by-Sequencing via MutMap Identifies a Mutation in ZmCLE7 Underlying Fasciation in a Newly Developed EMS Mutant Population in an Elite Tropical Maize Inbred", Genes vol. 11, No. 3, 2020.

Trung, Khuat Huu, et al., "A Weak Allele of Fasciated Ear 2 (FEA2) Increases Maize Kernel Row Number (KRN) and Yield in Elite Maize Hybrids", Agronomy 10, 2020, 1774.

Wu, Qingyu, et al., "All together now, a magical mystery tour of the maize shoot meristem", Current Opinion in Plant Biology 45(part A), 2018, 26-35.

Yamaguchi, Yasuka L., et al., "A Collection of Mutants for CLE-Peptide-Encoding Genes in *Arabidopsis* Generated by CRISPR/Cas9-Mediated Gene Targeting", Plant and Cell Phsiology vol. 58, No. 11, 2017, 1848-1856.

Yang, Yang, et al., "Precise editing of Clavata genes in *Brassica napus* L. regulates multilocular silique development", Plant Biotechnol J 16, 2018, 1322-1335.

Zhu, Y., et al., "Analysis of interactions among the Clavata3 receptors reveals a direct interaction between Clavata2 and Coryne in *Arabidopsis*", Plant J 61: 223-233, 2009.

Zsogon, Agustin, et al., "Genome editing as a tool to achieve the crop ideotype and derelatives: Case study in tomato", Plant Science 256, 2017, 120-130.

Database: UniProt [online]: A0A5J9V4K0_9POAL. Protein Recommended Name: Protein kinase domain-containing protein, Dec. 11, 2019. Retrieved from: https://www.uniprot.org/uniprot/A0A5J9V4K0, 2 pages.

Bettembourg, Mathilde, et al., "Root cone angle is enlarged in docs1 LRR-RLK mutants in rice", Rice, 10(1), 2017, 1-8.

Bommert, Peter, et al., "thick tassel dwarf1 encodes a putative maize ortholog of the *Arabidopsis* Clavata1 leucine-rich repeat receptor-like kinase", Development, 132(6), 2005, 1235-1245.

Carballo, Jose, et al., "A high-quality genome of Eragrostis curvula grass provides insights into Poaceae evolution and supports new strategies to enhance forage quality", Scientific Reports, 9(Article: 10250), 2019, 1-15.

Deyoung, Brody J., et al., "The Clavata1-related BAM1, BAM2 and BAM3 receptor kinase-like proteins are required for meristem function in *Arabidopsis*", The Plant Journal, 45(1), 2006, 1-16.

Diévart, Anne, et al., "Clavata1 Dominant-Negative Alleles Reveal Functional Overlap between Multiple Receptor Kinases That Regulate Meristem and Organ Development", The Plant Cell, 15(5), 2003, 1198-1211.

Fletcher, Jennifer C., "The CLV-WUS Stem Cell Signaling Pathway: A Roadmap to Crop Yield Optimization", Plants 7(4), 2018, 1-11.

Hu, Chong, et al., "A group of receptor kinases are essential for Clavata signalling to maintain stem cell homeostasis", Nature Plants, 4, 2018, 205-211.

Kinoshita, Atsuko, et al., "RPK2 is an essential receptor-like kinase that transmits the CLV3 signal in *Arabidopsis*", Development, 137(22), 2010, 3911-3920.

Liu, Chang, et al., "Natural variation in the Thick Tassel Dwarf1 (TD1) gene in the regulation of maize (*Zea mays* L.) ear-related traits", Breeding Science, 69(2), 2019, 323-331.

Nimchuk, Zachary L., et al., "Plant stem cell maintenance by transcriptional cross-regulation of related receptor kinases", Development, 142(6), 2015, 1043-1049.

Shpak, Elena D., et al., "Dominant-Negative Receptor Uncovers Redundancy in the *Arabidopsis* Erecta Leucine-Rich Repeat Receptor-Like Kinase Signaling Pathway That Regulates Organ Shape", The Plant Cell, 15(5), 2003, 1095-1110.

Xu, Cao, et al., "A cascade of arabinosyltransferases controls shoot meristem size in tomato", Nature Genetics, 47 (7), 2015, 784-792.

International Search Report and Written Opinion corresponding to International Application No. PCT/US2021/037740, mailed Dec. 2, 2021, 22 pages.

* cited by examiner

CLV1-12
A M V D¹⁴⁴ L E V L (SEQ ID NO:225)

CLV1-13
G Y V⁷⁵⁶ A N K D (SEQ ID NO:227)

CLV1-4  CLV1-8

CLV1-9

CLV1-10

CLV1-6  CLV1-2  CLV1-1
CLV1-7          CLV1-10

G Y Y N²²⁷ S Y T G (SEQ ID NO:226)
CLV1-11

FIG. 1

| | | SEQ ID NO: |
|---|---|---|
| 1. ZM00001D048832_01DKD2 CDS TRANSLATION EXTRACTION | IVHCDLKPSNILLNEDFGALVGDFGIAKIL | 123 |
| 2. ZM00001D037840_01DKD2 CDS TRANSLATION EXTRACTION | IIHRDVKAANILLDGNFEAIVGDFGLAKLL | 124 |
| 3. ZM00001D016197_01DKD2 CDS TRANSLATION EXTRACTION | IIHRDVKAANILLDGNFEAIVGDFGLAKLL | 124 |
| 4. ZM00001D017913_01DKD2 CDS TRANSLATION EXTRACTION | IIHRDVKAANILLDDCCEAIVGDFGLAKLL | 125 |
| 5. ZM00001D039678_01DKD2 CDS TRANSLATION EXTRACTION | IIHRDVKASNVLLDEYFEAIVGDFGLAKLL | 126 |
| 6. ZM00001D008724_01DKD2 CDS TRANSLATION EXTRACTION | IIHRDVKASNVLLDEYFEAIVGDFGLAKLL | 126 |
| 7. ZM00001D022066_01DKD2 CDS TRANSLATION EXTRACTION | ILHRDVKPSNILLDTNYTAYLSDFGLARLL | 127 |
| 8. ZM00001D048968_01DKD2 CDS TRANSLATION EXTRACTION | IVHRDVKSNNILLGDNLEARVADFGLAKFL | 128 |
| 9. ZM00001D007254_01DKD2 CDS TRANSLATION EXTRACTION | IVHRDVKSNNILLGDNLEARVADFGLAKFL | 128 |
| 10. ZM00001D039218_01DKD2 CDS TRANSLATION EXTRACTION | ILHRDVKSNNILLDARMEAHVADFGLAKFL | 129 |
| 11. ZM00001D028317_01DKD2 CDS TRANSLATION EXTRACTION | ILHRDVKSNNILLDADFEAHVADFGLAKFL | 130 |
| 12. ZM00001D018752_01DKD2 CDS TRANSLATION EXTRACTION | ILHRDVKSNNILLDSDFEAHVADFGLAKFL | 131 |
| 13. ZM00001D034240_01DKD2 CDS TRANSLATION EXTRACTION | ILHRDVKSNNILLDSNFEAHVADFGLAKFL | 132 |
| 14. ZM00001D013162_01DKD2 CDS TRANSLATION EXTRACTION | ILHRDVKSNNILLDSNFEAHVADFGLAKFL | 132 |

FIG. 2

```
ARABIDOPSIS            ILHRDVKSNNILLDSDFEAHVADFGLAKFLVDG--------AA-SECMSSIAGSYGYIAP
1. ZM00001D048832*     IVHCDLKPSNILLNEDFGALVGDFGIAKIIRDSTGDPSNMNSRSSTGTGIRGTIGVAP
2. ZM10001D036887*                                                       TIGHIAP
3. ZM00001D037840*     ILHRDVKAANILLDGNFEAIVGDFGLAKLLD--------RQESHVTTAIRGTIGHIAP
4. ZM00001D016197*     ILHRDVKAANILLDGNFEAIVGDFGLAKLLD--------RQESHVTTAVRGTIGHIAP
5. ZM00001D017913*     ILHRDVKAANILLDDCCEAIVGDFGLAKLLD--------HRESHVTTAVRGTVGHIAP
6. ZM00001D039678*     ILHRDVKASNVLLDEYFEAIVGDFGLAKLLD--------HRESHVTTAVRGTVGHIAP
7. ZM00001D008724*     ILHRDVKASNVLLDEYFEAIVGDFGLAKLLD--------HRESHVTTAVRGTVGHIAP
8. ZM00001D022066*     ILHRDVKPSNILLDTNYTAYLSDFGLARLLG--------NSETHATTGVAGTFGYAP
9. ZM00001D048968*     IVHRDVKSNNILLGDNLEARVADFGLAKFLRS--------GATSECMSAVAGSYGYIAP
10. ZM00001D007254*    IVHRDVKSNNILLGDNLEARVADFGLAKFLRC--------GATSESMSAVAGSYGYIAP
11. ZM00001D039218*    ILHRDVKSNNILLDARMEAHVADFGLAKFLGG--------SGASECMSAVAGSYGYIAP
12. ZM00001D028317*    ILHRDVKSNNILLDADFEAHVADFGLAKFLRGN-------AGGSECMSAIAGSYGYIAP
13. ZM00001D018752*    ILHRDVKSNNILLDSDFEAHVADFGLAKFLQD--------SGASQCMSAIAGSYGYIAP
14. ZM00001D034240*    ILHRDVKSNNILLDSNFEAHVADFGLAKFLQD--------SGASECMSAIAGSYGYIAP
15. ZM00001D013162*    ILHRDVKSNNILLDSNFEAHVADFGLAKFLQD--------SGASECMSAIAGSYGYIAP
```

```
                                                                                SEQ ID NO:
ARABIDOPSIS            ------------------------------EYAYTLKVDEKSDVYSFGVLLELI     194
1. ZM00001D048832*     ------------------------------E-YGEGHQVSPCGDVYSFGILLLELF    195
2. ZM10001D036887*     ------------------------------EYLSTGQSSEKTDVYGFGILLLELI    196
3. ZM00001D037840*     ------------------------------EYLSTGQSSEKTDVYGIGILLLELI    197
4. ZM00001D016197*     ------------------------------EYLSTGQSSEKTDVYGFGILLLELI    198
5. ZM00001D017913*     ------------------------------EYLSTGQSSEKTDVFGFGILLLELI    199
6. ZM00001D039678*     ------------------------------EYLSTGQSSEKTDVFGFGVLLVELI    200
7. ZM00001D008724*     ------------------------------EYLSTGQSSEKTDVFGFGVLLVELV    201
8. ZM00001D022066*     ------------------------------EYAMTCRVSDKADVYSYGVIMELI    202
9. ZM00001D048968*     ------------------------------YAYTLRVDEKSDVYSYGVLLELI     203
10. ZM00001D007254*    ------------------------------YAYTLKVDEKSDVYSFGVLLELI     204
11. ZM00001D039218*    ------------------------------YAYTLKVDEKSDVYSFGVLLELI     205
12. ZM00001D028317*    FRRVCRENGSSLGIVGCDIMMPRFLCPPSPEYAYTLKVDEKSDVYSFGVLLELI     206
13. ZM00001D018752*    ------------------------------EYAYTLKVDEKSDVYSFGVLLELV    207
14. ZM00001D034240*    ------------------------------YAYTLKVDEKSDVYSFGVLLELV     208
15. ZM00001D013162*    ------------------------------YAYTLKVDEKSDVYSFGVLLELV     209
* 01DKD2 CDS TRANSLATION
```

FIG. 3

| | | SEQ ID NO: |
|---|---|---|
| ARABIDOPSIS | GYIAPEYAYTLKVDEKSDVYSFGVVLLELIAGKKPV--GEF--GEGVDIVRWVRNTEE-EITQPSDAAI | 210 |
| 1. ZM00001D048832* | GYVAPEYGEGHQVSPCGDVYSFGILLLELFTGKAPT---NDMFADGLSLQGYVQAAFP-D--HLVDIVD | 211 |
| 2. ZM10001D036887* | GHIAPEYLSTGQSSEKTDVYGFGILLLELITGPKTLSNGHGQSQKGM-ILDWV-RELK-EDKRLDKLVD | 212 |
| 3. ZM00001D037840* | GHIAPEYLSTGQSSEKTDVYGIGILLLELITGPKTLSNGHGQSQKGM-ILDWV-RELK-EDKRLDKLVD | 213 |
| 4. ZM00001D016197* | GHIAPEYLSTGQSSEKTDVFGFGILLLELITGPKTLSNGHGQSQKGM-ILDWV-RELK-EDKRPDKLVD | 214 |
| 5. ZM00001D017913* | GHIAPEYLSTGQSSEKTDVFGFGILLLELITGQTALEFGKSSNQKGA-MLDWV-KKMH-QEKQLDILVD | 215 |
| 6. ZM00001D039678* | GHIAPEYLSTGQSSEKTDVFGFGVLLVELITGQKALDFGRVANQKGG-VLDWV-KKLH-QEKQLGTMVD | 216 |
| 7. ZM00001D008724* | GHIAPEYLSTGQSSEKTDVFGFGVLLVELVTGQKALDFGRVANQKGG-VLDWV-KKLH-QEKQLGVMVD | 217 |
| 8. ZM00001D022066* | GYVAPEYAMTCRVSDKADVYSYGVVLMELISDKKALDPSFSPYGNGFNIVAWACMLLR-QGRAREFFI | 218 |
| 9. ZM00001D048968* | GYIAP-YAYTLRVDEKSDVYSYGVVLLELITGRRPG--GDF--GEGVDIVQWAKRATA-GRREAVPGIA | 219 |
| 10. ZM00001D007254* | GYIAP-YAYTLRVDEKSDVYSYGVVLLELITGRRPGDFGE----GVDIVQWAKRATA-GRREAVPGVD | 220 |
| 11. ZM00001D039218* | GYIAP-YAYTLKVDEKSDVYSFGVVLLELITGLKPV--GEHLGDDAVDLVQWARARSS-AGGGVLALL | 221 |
| 12. ZM00001D018752* | GYIAP-YAYTLKVDEKSDVYSFGVVLLELVTGKKPV--GEF--GDGVDIVHWVRSTTAGASKEQVVKVM | 222 |
| 12. ZM00001D034240* | GYIAPEYAYTLKVDEKSDVYSFGVVLLELVTGRKPV--GEF--GDGVDIVQWAKMTTNSNKEQVMKVL | 223 |
| 13. ZM00001D013162* | GYIAP-YAYTLKVDEKSDVYSFGVVLLELVTGRKPV--GEF--GDGVDIVQWAKLTTGSKKEQVMRIL | 224 |

* 01DKD2 CDS TRANSLATION

FIG. 4

METHODS FOR CONTROLLING MERISTEM SIZE FOR CROP IMPROVEMENT

STATEMENT OF PRIORITY

This application claims the benefit, under 35 U.S.C. § 119 (e), of U.S. Provisional Application No. 63/040,044 filed on Jun. 17, 2020, the entire contents of which is incorporated by reference herein.

STATEMENT REGARDING ELECTRONIC FILING OF A SEQUENCE LISTING

A Sequence Listing in ASCII text format, submitted under 37 C.F.R. § 1.821, entitled 1499.27.WO_ST25.txt, 771,265 bytes in size, generated on Jun. 16, 2021 and filed via EFS-Web, is provided in lieu of a paper copy. This Sequence Listing is hereby incorporated herein by reference into the specification for its disclosures.

FIELD OF THE INVENTION

This invention relates to compositions and methods for modifying genes for Leucine Rich Repeat Receptor Like Protein Kinase (LRR-RLK) in plants, optionally to increase kernel row number. The invention further relates to plants having increased kernel row number produced using the methods and compositions of the invention.

BACKGROUND OF THE INVENTION

New plant organs are initiated at the growing tip of the plant called the meristem. In the meristem a population of undifferentiated stem cells is maintained. During growth, the meristem allocates stem-cells to newly formed organs, including seeds, while at the same time reserving some stem-cells to continually maintain the meristem. Several conserved molecular mechanisms have been described that control the size of the stem cell population to ensure organized growth and proper meristem size.

As a result of the modular nature of maize ear development, larger meristems tend to initiate more flowers, and thus, meristem size has a direct effect on kernel row number and yield. The number of flowers initiated during the development of the maize ear directly limits grain yield. An increased number of flowers initiated around the circumference of the ear (kernel row number or KRN) was a major trait selected during maize domestication. Significant advancements through breeding have resulted in dramatic increases in kernel row number, from 2 in teosinte, the ancestor of maize, to ~8-20 rows in modern elite maize varieties. In diverse maize lines kernel row number can get as high as 36.

In the canonical regulatory pathway described in the model plant *Arabidopsis*, CLAVATA3 (CLV3) peptide is secreted from cells in the meristem apex and moves through the apoplast into the central stem-cell domain where it interacts with several Leucine Rich Receptors (LRRs) including CLAVATA1 (CLV1) and CLAVATA2 (CLV2). This receptor-ligand interaction stimulates signaling that ultimately acts to reduce WIS expression and restrict the expansion of the stem cell population. One of the targets of WUS is the (LV3 gene itself, and in this way WUS acts to limit its own expression and maintain stem cell homeostasis (Fletcher, J. C., *Plants* 7:87 (2018)).

Loss of function mutations in (IVI, CLV2, or (LV3 result in an expansion of the WUS domain and increased meristem size (Schoof et al., *Cell* 100:635-644 (2000)). Often this increase in meristem size results in aberrant plant growth because the meristem expands uncontrollably and becomes disorganized, a phenomenon called fasciation (Je et al., *Nat Genet* 48: ng.3567 (2016a)). Importantly, a larger meristem does not just make larger organs, but rather an increased number of organs around a larger area. Because of this relationship between meristem size and organ number, mutations in maize CLV-WUS signaling genes can lead to increased flower number and yield.

Several dominant-negative CLV1 alleles have been described in *Arabidopsis* and tomato where single amino acid changes render the kinase domain non-functional. These kinase-dead proteins continue to interact with other factors in the receptor protein complex but do not mediate downstream signaling because their ability to phosphorylate downstream targets is impaired. The mutant protein has a dominant effect on signaling because it competes with wildtype CLV1 receptors, and presumably other LRR-RLKs with functional overlap with CLV1. Novel and genetically dominant strategies for modulating meristem size are needed to improve hybrid crop performance.

SUMMARY OF THE INVENTION

One aspect of the invention provides a plant or plant part thereof comprising at least one mutation in an endogenous Leucine Rich Repeat Receptor Like Protein Kinase (LRR-RLK) gene that encodes a LRR-RLK protein.

A second aspect of the invention provides a plant cell, comprising an editing system comprising: (a) a CRISPR-Cas effector protein; and (b) a guide nucleic acid (gRNA, gDNA, crRNA, crDNA, sgRNA, sgDNA) comprising a spacer sequence with complementarity to an endogenous target gene encoding a LRR-RLK protein.

A third aspect of the invention provides corn plant cell comprising at least one mutation within a LRR-RLK gene that results in a null allele, a dominant negative allele, a semi-dominant allele, a hypomorphic mutation, or a weak loss-of-function allele, wherein the mutation is a substitution, insertion or a deletion that is introduced using an editing system that comprises a nucleic acid binding domain that binds to a target site in the LRR-RIK gene.

A fourth aspect of the invention provides a method of producing/breeding a transgene-free edited corn plant, comprising: crossing the corn plant of the invention with a transgene free corn plant, thereby introducing the at least one mutation into the corn plant that is transgene-free; and selecting a progeny corn plant that comprises the at least one mutation and is transgene-free, thereby producing a transgene free edited corn plant.

A fifth aspect of the invention provides a method of providing a plurality of corn plants having increased kernel row number, the method comprising planting two or more plants of the invention in a growing area, thereby providing a plurality of corn plants having increased kernel row number as compared to a plurality of control corn plants not comprising the mutation.

A sixth aspect of the invention provides a method of generating variation in a region of a corn LRR-RLK protein, comprising: introducing an editing system into a corn plant cell, wherein the editing system is targeted to a region of a corn LRR-RIK gene that encodes a portion of the corn LRR-RLK protein, wherein the portion comprises any one of the amino acid sequences of SEQ ID NO:117-174; and contacting the region of the corn LRR-RLK gene with the editing system, thereby introducing into the corn plant cell a mutation into the region of the corn LRR-RLK protein; and generating variation in the region of the LRR-RLK protein.

A seventh aspect of the invention provides a method for editing a specific site in the genome of a corn plant cell, the method comprising: cleaving, in a site specific manner, a target site within an endogenous LRR-RLK gene in the corn plant cell, the endogenous LRR-RIK gene: comprising a sequence having at least 90% sequence identity to any one of the nucleotide sequences of SEQ ID NOs: 72-85, or encoding: (a) a sequence having at least 90% sequence identity to any one of the amino acid sequences of SEQ ID NOs: 86-100; (b) a sequence comprising one or more motifs having: (i) the sequence of $IX_1HX_2DX_3K$ (SEQ ID NO: 118), wherein $X_1$=V, I, or L, $X_2$=R or C and $X_3$=L or V, (ii) the sequence of NXLL (SEQ ID NO:119), wherein X=I or V, (iii) the sequence of $DFGLAXIX2L$ (SEQ ID NO: 120) wherein $X_1$=K or R and $X_2$=L or F, (iv) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (c) a region having the sequence of any one of the amino acid sequences of SEQ ID NOs: 123-179, thereby generating an edit in the endogenous LRR-RLK gene of the corn plant cell and producing a corn plant cell comprising the edit in the endogenous LRR-RLK gene.

An eighth aspect provides a method for making a corn plant, comprising: (a) contacting a population of corn plant cells comprising a wild-type endogenous LRR-RLK gene with a nuclease linked to a nucleic acid binding domain (e.g., a DNA binding domain, e.g., editing system) that binds to a sequence (1) having at least 90% sequence identity to any one of the nucleotide sequences of SEQ ID NOs: 72-85; or (2) encoding (i) a sequence having at least 90% sequence identity to any one of the amino acid sequences of SEQ ID NOs: 86-100; (ii) a sequence comprising one or more motifs having: a) the sequence of $IX_1HX_2DX_3K$ (SEQ ID NO:118), wherein $X_1$=V, I, or L, $X_2$=R or C and $X_3$=L or V, b) the sequence of NXLL (SEQ ID NO:119), wherein X=I or V, c) the sequence of $DFGLAX_1X_2L$ (SEQ ID NO:120) wherein $X_1$=K or R and $X_2$=L or F, d) the sequence of $DVX_1X_2X_3GX_4X_6LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or e) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (iii) a region having the sequence of any one of the amino acid sequences of SEQ ID NOs: 123-179; (b) selecting a corn plant cell from the population that comprises at least one mutation in the wild-type endogenous LRR-RLK gene, wherein the at least one mutation results in a null allele, a dominant negative allele, a semi-dominant allele, a hypomorphic allele, or a weak loss-of-function allele; and (c) growing the selected plant cell into a corn plant.

A ninth aspect provides a method for increasing kernel row number in a corn plant, comprising (a) contacting a corn plant cell comprising an endogenous LRR-RLK gene with a nuclease targeting the endogenous LRR-RLK gene, wherein the nuclease is linked to a nucleic acid binding domain (e.g., a DNA binding domain, e.g., editing system) that binds to a target site in the endogenous LRR-RLK gene, wherein the endogenous LRR-RLK gene: (i) comprises a sequence having at least 90% sequence identity to any one of the nucleotide sequences of SEQ ID NOs: 72-85; (ii) encodes a sequence having at least 90% sequence identity to any one of the amino acid sequences of SEQ ID NOs: 86-100; (iii) encodes a sequence having at least 90% sequence identity to a sequence comprising one or more motifs having: a) the sequence of $IX_1HX_2DX_3K$ (SEQ ID NO:118), wherein $X_1$=V, I, or L, $X_2$=R or C and $X_3$=L or V, b) the sequence of NXLL (SEQ ID NO:119), wherein X=I or V, c) the sequence of $DFGLAX_1X_2L$ (SEQ ID NO:120) wherein $X_1$=K or R and $X_2$=L or F, d) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or e) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (iv) encodes a sequence comprising a region having the sequence of any one of the amino acid sequences of SEQ ID NOs: 123-179 to produce a corn plant cell comprising a mutation in the endogenous LRR-RLK gene, thereby producing the corn plant comprising at least one cell (e.g., one or more) having a mutation in the endogenous LRR-RLK gene; and (b) growing the corn plant cell into a corn plant comprising the mutation in the endogenous LRR-RLK gene, thereby producing a corn plant have a mutated endogenous LRR-RLK gene and an increased kernel row number.

A tenth aspect provides method for producing a corn plant or part thereof comprising at least one cell (e.g., one or more) having a mutated endogenous LRR-RLK gene, the method comprising contacting a target site in an endogenous LRR-RLK gene in the corn plant or plant part with a nuclease comprising a cleavage domain and a nucleic acid binding domain, wherein the nucleic acid binding domain binds to a target site in the endogenous LRR-RLK gene, wherein the endogenous LRR-RLK gene (a) comprises a sequence having at least 90% sequence identity to any one of the nucleotide sequences of SEQ ID NOs: 72-85; (b) encodes a sequence having at least 90% sequence identity to any one of the amino acid sequences of SEQ ID NOs: 86-100; (c) encodes a sequence having at least 90% sequence identity to a sequence comprising one or more motifs having: (i) the sequence of $IX_1HX_2DX_3K$ (SEQ ID NO: 118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO: 120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (d) encodes a sequence comprising a region having the sequence of any one of the amino acid sequences of SEQ ID NOs: 123-179 to produce a plant cell comprising a mutation in the endogenous LRR-RLK gene, thereby producing the corn plant or part thereof comprising at least one cell (e.g., one or more) having a mutation in the endogenous LRR-RIK gene.

An eleventh aspect of the invention provides a method for producing a corn plant or part thereof comprising a mutated endogenous LRR-RLK gene and exhibiting increased kernel row number (e.g., producing ears having increased kernel row number, optionally without substantially decreasing the length of the ear, e.g., without decreasing ear length more than 30% as compared to an ear of a plant not comprising the same LRR-RLK mutation)), the method comprising contacting a target site in an endogenous LRR-RLK gene in the corn plant or plant part with a nuclease comprising a cleavage domain and a nucleic acid binding domain, wherein the nucleic acid binding domain binds to a target site in the endogenous LRR-RLK gene, wherein the endogenous LRR-RLK gene (a) comprises a sequence having at least 90% sequence identity to any one of the nucleotide sequences of SEQ ID NOs: 72-85; (b) encodes a sequence having at least 90% sequence identity to any one of the amino acid sequences of SEQ ID NOs: 86-100; (c) encodes a sequence having at least 90% sequence identity to a sequence comprising one or more motifs having: (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (d) encodes a sequence comprising a region having the sequence of any one of the amino acid sequences of SEQ ID NOs: 123-179, thereby producing the corn plant or part thereof comprising an endogenous LRR-RLK gene having a mutation and exhibiting increased kernel row number, optionally without substantially decreasing the length of the ear (e.g., without decreasing ear length more than 30% as compared to an ear of a plant not comprising the same LRR-RLK mutation).

A twelfth aspect provides a guide nucleic acid that binds to a target site in a LRR-RLK gene, the target site (a) comprising a sequence having at least 90% sequence identity to any one of the amino acid sequences of SEQ ID NOs: 86-100; (b) having a sequence comprising one or more motifs having (i) the sequence of $IX_1HX_2DX_3K$ (SEQ ID NO:118), wherein $X_1$ =V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (c) comprising a region having the sequence of any one of the amino acid sequences of SEQ ID NOs: 123-179.

In a thirteenth aspect, a system is provided comprising a guide nucleic acid of the invention and a CRISPR-Cas effector protein that associates with the guide nucleic acid.

A fourteenth aspect provides a gene editing system comprising a CRISPR-Cas effector protein in association with a guide nucleic acid, wherein the guide nucleic acid comprises a spacer sequence that binds to an endogenous LRR-RLK gene.

In a fifteenth aspect, a complex comprising a CRISPR-Cas effector protein comprising a cleavage domain and a guide nucleic acid, wherein the guide nucleic acid binds to a target site in an endogenous LRR-RLK gene, wherein the endogenous LRR-RLK gene, wherein the endogenous LRR-RLK gene: (a) comprises a sequence having at least 90% sequence identity to any one of the nucleotide sequences of SEQ ID NOs: 72-85; (b) encodes a sequence having at least 90% sequence identity to any one of the amino acid sequences of SEQ ID NOs: 86-100; (c) encodes a sequence having at least 90% sequence identity to a sequence comprising one or more motifs having: (i) the sequence of $IX_1HX_2DX_3K$ (SEQ ID NO: 118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO: 120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO: 121), wherein $X_1$=S or T, $X_2$=A, G or S, $X_3$=V or I, $X_4$=A or R, $X_5$=T or S; and/or (d) encodes a sequence comprising a region having the sequence of any one of the amino acid sequences of SEQ ID NOs: 123-179, wherein the cleavage domain cleaves a target strand in the LRR-RLK gene.

In sixteenth aspect, an expression cassette is provided, the expression cassette comprising a (a) polynucleotide encoding CRISPR-Cas effector protein comprising a cleavage domain and (b) a guide nucleic acid that binds to a target site in an endogenous LRR-RLK gene, wherein the guide nucleic acid comprises a spacer sequence that is complementary to and binds to (i) a portion of a nucleic acid encoding an amino acid sequence having at least 90% sequence identity to any one of the amino acid sequences of SEQ ID NOs: 86-100; (ii) a portion of a sequence having at least 90% sequence identity to any one of the nucleotide sequences of SEQ ID NOs: 72-85; and/or (iii) a region having the sequence of any one of the amino acid sequences of SEQ ID NOs: 117-174.

In an additional aspect, a method of creating a mutation in an endogenous LRR-RLK gene in a plant, comprising: targeting a gene editing system to a portion of the LRR-RIK gene that comprises at least one (one or more) amino acid residue located: (a) at position 893, 918 and/or 943 with reference to amino acid position numbering of SEQ ID NO:87; (b) at position 187, 203 and/or 228 with reference to amino acid position numbering of SEQ ID NO: 88; (c) at position 451, 467 and/or 492 with reference to amino acid position numbering of SEQ ID NO:89; (d) at position 453, 469 and/or 494 with reference to amino acid position numbering of SEQ ID NO:90; (e) at position 468, 484 and/or 509 with reference to amino acid position numbering of SEQ ID NO:91; (f) at position 449, 465, and/or 490 with reference to amino acid position numbering of SEQ ID NO:92; (g) at position 928, 944, and/or 969 with reference to amino acid position numbering of SEQ ID NO:93; (h) at position 857, 874 and/or 898 with reference to amino acid position numbering of SEQ ID NO: 94; SEQ ID NO:96; (i) at position 853, 870 and/or 894 with reference to amino acid position numbering of SEQ ID NO:95; (j) at position 827, 845 and/or 900 with reference to amino acid position numbering of SEQ ID NO:97; (k) at position 844, 861 and/or 885 with reference to amino acid position numbering of SEQ ID NO:98; (l) at position 835, 852, and/or 877 with reference to amino acid position numbering of SEQ ID NO:99; (m) at position 840, 857 and/or 881 with reference to amino acid position numbering of SEQ ID NO: 100; or (n) at position 839, 856 and/or 881 with reference to amino acid position numbering of SEQ ID NO:86; and selecting a plant that comprises an alternative amino acid at the positions set forth in (a)-(n).

A further aspect of the invention provides a nucleic acid encoding null mutation, a dominant negative mutation, a semi-dominant mutation, a hypomorphic mutation, or a weak loss-of-function mutation of a corn LRR-RLK protein.

In an additional aspect, a corn plant or part thereof is provided comprising a nucleic acid of the invention.

In a further aspect, a corn plant or part thereof is provided that produces ears having increased kernel row number, optionally without substantially decreasing the length of the ears.

In some aspects, a corn plant is provided that also exhibits increased yield, and improved disease resistance as well as exhibits larger meristems and root meristems that are maintained.

Further provided are plants comprising in their genome one or more mutated Leucine Rich Repeat Receptor Like Protein Kinase (LRR-RLK) genes produced by the methods of the invention as well as polypeptides, polynucleotides, nucleic acid constructs, expression cassettes and vectors for making a plant of this invention.

These and other aspects of the invention are set forth in more detail in the description of the invention below.

BRIEF DESCRIPTION OF THE SEQUENCES

SEQ ID NOs: 1-17 are exemplary Cas12a amino acid sequences useful with this invention.

SEQ ID NOs: 18-20 are exemplary Cas12a nucleotide sequences useful with this invention.

SEQ ID NO:21-22 are exemplary regulatory sequences encoding a promoter and intron.

SEQ ID NOs: 23-29 are exemplary cytosine deaminase sequences useful with this invention.

SEQ ID NOs: 30-40 are exemplary adenine deaminase amino acid sequences useful with this invention.

SEQ ID NO:41 is an exemplary uracil-DNA glycosylase inhibitor (UGI) sequences useful with this invention.

SEQ ID NOs: 42-44 provides an example of a protospacer adjacent motif position for a Type V CRISPR-Cas12a nuclease.

SEQ ID NOs: 45-47 provide example peptide tags and affinity polypeptides useful with this invention.

SEQ ID NOs: 48-58 provide example RNA recruiting motifs and corresponding affinity polypeptides useful with this invention.

SEQ ID NOs: 59-60 are exemplary Cas9 polypeptide sequences useful with this invention.

SEQ ID NOs: 61-71 are exemplary Cas9 polynucleotide sequences useful with this invention.

SEQ ID NOs: 72-85 are example LRR-RLK polynucleotide sequences.

SEQ ID NOs: 86-100 are example LRR-RLK polypeptide sequences.

SEQ ID NOs: 101-117 and SEQ ID NOs: 243-266 are example spacer sequences for nucleic acid guides useful with this invention.

SEQ ID NOs: 118-122 are example LRR-RLK polypeptide motifs.

SEQ ID NO:123-179 are example target regions of LRR-RLK polypeptides useful with this invention.

SEQ ID NOs: 180-193 are example edited LRR-RLK polypeptides.

SEQ ID NOs: 194-209 are sequences in FIG. 3.

SEQ ID NOs: 210-224 are sequences in FIG. 4.

SEQ ID NOs: 225-227 are sequences in FIG. 1

SEQ ID NOs: 228-242 are example *Zea mays* LRR-RLK genomic sequences.

BRIEF DESCRIPTION OF THE DRAWINGS

FIG. 1 provides a schematic of dominant negative clv1 mutant alleles.

FIG. 2 provides an alignment of portions of LRR-RLK orthologues.

FIG. 3 provides an alignment of portions of LRR-RLK orthologues.

FIG. 4 provides an alignment of portions of LRR-RLK orthologues.

DETAILED DESCRIPTION

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as an amount or concentration and the like, is meant to encompass variations of ±10%, ±5%, ±1%, ±0.5%, or even ±0.1% of the specified value as well as the specified value. For example, "about X" where X is the measurable value, is meant to include X as well as variations of ±10%, ±5%, ±1%, ±0.5%, or even ±0.1% of X. A range provided herein for a measureable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

Recitation of ranges of values herein are merely intended to serve as a shorthand method of referring individually to each separate value falling within the range, unless otherwise indicated herein, and each separate value is incorporated into the specification as if it were individually recited herein. For example, if the range 10 to 15 is disclosed, then 11, 12, 13, and 14 are also disclosed, along with 10 and 15.

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the terms "increase," "increasing," "increased," "enhance," "enhanced," "enhancing," and "enhancement" (and grammatical variations thereof) describe an elevation of at least about 5%, 10%, 15%, 20%, 25%, 50%, 75%, 100%, 150%, 200%, 300%, 400%, 500% or more as compared to a control. For example, a plant comprising a mutation in a LRR-RLK gene as described herein can exhibit increased kernel row number that is at least about 5% or greater than that of a control plant not comprising the same mutation, optionally without substantially decreasing the length of the ear (e.g., without decreasing ear length more than 30% as compared to an ear of a plant not comprising the same LRR-RLK mutation). A control plant is typically the same plant as the edited plant but the control plant has not been similarly edited and therefore does not comprise the mutation.

A "control" plant may be an isogenic plant and/or a wild type plant. Thus, a control plant can be the same breeding line, variety, or cultivar as the subject plant into which a mutation as described herein is introgressed, but the control breeding line, variety, or cultivar is free of the mutation. In some embodiments, a comparison between a plant of the invention and a control plant is made under the same growth conditions, e.g., the same environmental conditions (soil, hydration, light, heat, nutrients and the like).

As used herein, the terms "reduce," "reduced," "reducing," "reduction," "diminish," and "decrease" (and grammatical variations thereof), describe, for example, a decrease of at least about 5%, 10%, 15%, 20%, 25%, 35%, 50%, 75%, 80%, 85%, 90%, 95%, 96%, 97%, 98%, 99%, 99.5%, 99.6%, 99.7%, 99.8%, 99.9%, or 100% as compared to a control. In particular embodiments, the reduction can result in no or essentially no (i.e., an insignificant amount, e.g., less than about 10% or even 5%) detectable activity or amount.

As used herein, the terms "express," "expresses," "expressed" or "expression," and the like, with respect to a nucleic acid molecule and/or a nucleotide sequence (e.g., RNA or DNA) indicates that the nucleic acid molecule and/or a nucleotide sequence is transcribed and, optionally, translated. Thus, a nucleic acid molecule and/or a nucleotide sequence may express a polypeptide of interest or, for example, a functional untranslated RNA.

A "heterologous" or a "recombinant" nucleotide sequence is a nucleotide sequence not naturally associated with a host cell into which it is introduced, including non-naturally occurring multiple copies of a naturally occurring nucleotide sequence. A "heterologous" nucleotide/polypeptide may originate from a foreign species, or, if from the same species, is substantially modified from its native form in composition and/or genomic locus by deliberate human intervention.

A "native" or "wild type" nucleic acid, nucleotide sequence, polypeptide or amino acid sequence refers to a naturally occurring or endogenous nucleic acid, nucleotide sequence, polypeptide or amino acid sequence. In some contexts, a "wild type" nucleic acid is a nucleic acid that is not edited as described herein and can differ from an "endogenous" gene that may be edited as described herein (e.g., a mutated endogenous gene). In some contexts, a "wild type" nucleic acid (e.g., unedited) may be heterologous to the organism in which the wild type nucleic acid is found (e.g., a transgenic organism). As an example, a "wild type endogenous Leucine Rich Repeat Receptor Like Protein Kinase (LRR-RLK) gene" is a LRR-RLK gene that is naturally occurring in or endogenous to the reference organism, e.g., a plant, e.g., a maize plant, and may be subject to modification as described herein, after which, such a modified endogenous gene is no longer wild type.

As used herein, the term "heterozygous" refers to a genetic status wherein different alleles reside at corresponding loci on homologous chromosomes.

As used herein, the term "homozygous" refers to a genetic status wherein identical alleles reside at corresponding loci on homologous chromosomes.

As used herein, the term "allele" refers to one of two or more different nucleotides or nucleotide sequences that occur at a specific locus.

A "null allele" is a nonfunctional allele caused by a genetic mutation that results in a complete lack of production of the corresponding protein or produces a protein that is non-functional.

A "dominant negative mutation" is a mutation that produces an altered gene product (e.g., having an aberrant function relative to wild type), which gene product adversely affects the function of the wild-type allele or gene product. For example, a "dominant negative mutation" may block a function of the wild type gene product. A dominant negative mutation may also be referred to as an "antimorphic mutation."

A "semi-dominant mutation" refers to a mutation in which the penetrance of the phenotype in a heterozygous organism is less than that observed for a homozygous organism.

A "weak loss-of-function mutation" is a mutation that results in a gene product having partial function or reduced function (partially inactivated) as compared to the wildtype gene product.

A "hypomorphic mutation" is a mutation that results in a partial loss of gene function, which may occur through reduced expression (e.g., reduced protein and/or reduced RNA) or reduced functional performance (e.g., reduced activity), but not a complete loss of function/activity. A "hypomorphic" allele is a semi-functional allele caused by a genetic mutation that results in production of the corresponding protein that functions at anywhere between 1% and 99% of normal efficiency.

A "hypermorphic mutation" is a mutation that results in increased expression of the gene product and/or increased activity of the gene product.

A "locus" is a position on a chromosome where a gene or marker or allele is located. In some embodiments, a locus may encompass one or more nucleotides.

As used herein, the terms "desired allele," "target allele" and/or "allele of interest" are used interchangeably to refer to an allele associated with a desired trait. In some embodiments, a desired allele may be associated with either an increase or a decrease (relative to a control) of or in a given trait, depending on the nature of the desired phenotype.

A marker is "associated with" a trait when said trait is linked to it and when the presence of the marker is an indicator of whether and/or to what extent the desired trait or trait form will occur in a plant/germplasm comprising the marker. Similarly, a marker is "associated with" an allele or chromosome interval when it is linked to it and when the presence of the marker is an indicator of whether the allele or chromosome interval is present in a plant/germplasm comprising the marker.

As used herein, the terms "backcross" and "backcrossing" refer to the process whereby a progeny plant is crossed back to one of its parents one or more times (e.g., 1, 2, 3, 4, 5, 6, 7, 8, etc.). In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. For example, see Ragot, M. et al. Marker-assisted Backcrossing: A Practical Example, in TECHNIQUES ET UTILISATIONS DES MARQUEURS MOLECULAIRES LES COLLOQUES, Vol. 72, pp. 45-56 (1995); and Openshaw et al., Marker-assisted Selection in Backcross Breeding, in PROCEEDINGS OF THE SYMPOSIUM "ANALYSIS OF MOLECULAR MARKER DATA," pp. 41-43 (1994). The initial cross gives rise to the F1 generation. The term "BC1" refers to the second use of the recurrent parent, "BC2" refers to the third use of the recurrent parent, and so on.

As used herein, the terms "cross" or "crossed" refer to the fusion of gametes via pollination to produce progeny (e.g., cells, seeds or plants). The term encompasses both sexual crosses (the pollination of one plant by another) and selfing (self-pollination, e.g., when the pollen and ovule are from the same plant). The term "crossing" refers to the act of fusing gametes via pollination to produce progeny.

As used herein, the terms "introgression," "introgressing" and "introgressed" refer to both the natural and artificial transmission of a desired allele or combination of desired alleles of a genetic locus or genetic loci from one genetic background to another. For example, a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. The desired allele may be a selected allele of a marker, a QTL, a transgene, or the like. Offspring comprising the desired allele can be backcrossed one or more times (e.g., 1, 2, 3, 4, or more times) to a line having a desired genetic background, selecting for the desired allele, with the result being that the desired allele becomes fixed in the desired genetic background. For example, a marker associated with increased yield under non-water stress conditions may be introgressed from a donor into a recurrent parent that does not comprise the marker and does not exhibit increased yield under non-water stress conditions. The resulting offspring could then be backcrossed one or more times and selected until the progeny possess the genetic marker(s) associated with increased yield under non-water stress conditions in the recurrent parent background.

A "genetic map" is a description of genetic linkage relationships among loci on one or more chromosomes within a given species, generally depicted in a diagrammatic or tabular form. For each genetic map, distances between loci are measured by the recombination frequencies between them. Recombination between loci can be detected using a variety of markers. A genetic map is a product of the mapping population, types of markers used, and the polymorphic potential of each marker between different populations. The order and genetic distances between loci can differ from one genetic map to another.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome. Genotypes can be indirectly characterized, e.g., using markers and/or directly characterized by nucleic acid sequencing.

As used herein, the term "germplasm" refers to genetic material of or from an individual (e.g., a plant), a group of individuals (e.g., a plant line, variety or family), or a clone derived from a line, variety, species, or culture. The germplasm can be part of an organism or cell, or can be separate from the organism or cell. In general, germplasm provides genetic material with a specific genetic makeup that provides a foundation for some or all of the hereditary qualities of an organism or cell culture. As used herein, germplasm includes cells, seed or tissues from which new plants may be grown, as well as plant parts that can be cultured into a whole plant (e.g., leaves, stems, buds, roots, pollen, cells, etc.).

As used herein, the terms "cultivar" and "variety" refer to a group of similar plants that by structural or genetic features and/or performance can be distinguished from other varieties within the same species.

As used herein, the terms "exotic," "exotic line" and "exotic germplasm" refer to any plant, line or germplasm that is not elite. In general, exotic plants/germplasms are not derived from any known elite plant or germplasm, but rather are selected to introduce one or more desired genetic elements into a breeding program (e.g., to introduce novel alleles into a breeding program).

As used herein, the term "hybrid" in the context of plant breeding refers to a plant that is the offspring of genetically dissimilar parents produced by crossing plants of different lines or breeds or species, including but not limited to the cross between two inbred lines.

As used herein, the term "inbred" refers to a substantially homozygous plant or variety. The term may refer to a plant or plant variety that is substantially homozygous throughout the entire genome or that is substantially homozygous with respect to a portion of the genome that is of particular interest.

A "haplotype" is the genotype of an individual at a plurality of genetic loci, i.e., a combination of alleles. Typically, the genetic loci that define a haplotype are physically and genetically linked, i.e., on the same chromosome segment. The term "haplotype" can refer to polymorphisms at a particular locus, such as a single marker locus, or polymorphisms at multiple loci along a chromosomal segment.

As used herein, the term "heterologous" refers to a nucleotide/polypeptide that originates from a foreign species, or, if from the same species, is substantially modified from its native form in composition and/or genomic locus by deliberate human intervention.

A plant in which at least one orthologous LRR-RLK gene encoding a LRR-RLK polypeptide is modified as described herein (e.g., comprises a modification as described herein) may have improved yield traits as compared to a plant that does not comprise the modification in the at least one orthologous LRR-RLK gene. As used herein, "improved yield traits" refers to any plant trait associated with growth, for example, biomass, yield, nitrogen use efficiency (NUE), inflorescence size/weight, fruit yield, fruit quality, fruit size, seed size, seed number, foliar tissue weight, nodulation number, nodulation mass, nodulation activity, number of seed heads, number of tillers, number of branches, number of flowers, number of tubers, tuber mass, bulb mass, number of seeds, total seed mass, rate of leaf emergence, rate of tiller/branch emergence, rate of seedling emergence, length of roots, number of roots, size and/or weight of root mass, or any combination thereof. Thus, in some aspects, "improved yield traits" may include, but is not limited to, increased inflorescence production, increased fruit production (e.g., increased number, weight and/or size of fruit; e.g., increase number, weight, and/or size of ears for, e.g., maize), increased fruit quality, increased number, size and/or weight of roots, increased meristem size, increased seed size, increased biomass, increased leaf size, increased nitrogen use efficiency, increased height, increased internode number and/or increased internode length as compared to a control plant or part thereof (e.g., a plant that does not comprise a mutated endogenous LRR-RLK nucleic acid (e.g., a mutated LRR-RLK gene)). Improved yield traits can also result from increased planting density of plants of the invention. Thus, in some aspects, a plant of the invention is capable of being planted at an increased density (as a consequence of altered plant architecture resulting from the endogenous mutation), which results in improved yield traits as compared to a control plant that is planted at the same density. In some aspects, improved yield traits can be expressed as quantity of grain produced per area of land (e.g., bushels per acre of land).

As used herein a "control plant" means a plant that does not contain an edited LRR-RIK gene or genes as described herein that imparts an enhanced/improved trait (e.g., yield trait) or altered phenotype. A control plant is used to identify and select a plant edited as described herein and that has an enhanced trait or altered phenotype as compared to the control plant. A suitable control plant can be a plant of the parental line used to generate a plant comprising a mutated LRR-RLK gene(s), for example, a wild type plant devoid of an edit in an endogenous LRR-RLK gene as described herein. A suitable control plant can also be a plant that contains recombinant nucleic acids that impart other traits, for example, a transgenic plant having enhanced herbicide tolerance. A suitable control plant can in some cases be a progeny of a heterozygous or hemizygous transgenic plant line that is devoid of the mutated LRR-RLK gene as described herein, known as a negative segregant, or a negative isogenic line.

An enhanced trait may be, for example, decreased days from planting to maturity, increased stalk size, increased number of leaves, increased plant height growth rate in vegetative stage, increased ear size, increased ear dry weight per plant, increased number of kernels per ear, increased weight per kernel, increased number of kernels per plant, decreased ear void, extended grain fill period, reduced plant height, increased number of root branches, increased total root length, increased yield, increased nitrogen use efficiency, and increased water use efficiency as compared to a control plant. An altered phenotype may be, for example, plant height, biomass, canopy area, anthocyanin content, chlorophyll content, water applied, water content, and water use efficiency.

As used herein a "trait" is a physiological, morphological, biochemical, or physical characteristic of a plant or particular plant material or cell. In some instances, this characteristic is visible to the human eye and can be measured mechanically, such as seed or plant size, weight, shape, form, length, height, growth rate and development stage, or can be measured by biochemical techniques, such as detecting the protein, starch, certain metabolites, or oil content of seed or leaves, or by observation of a metabolic or physiological process, for example, by measuring tolerance to water deprivation or particular salt or sugar concentrations, or by the measurement of the expression level of a gene or genes, for example, by employing Northern analysis, RT-PCR, microarray gene expression assays, or reporter gene expression systems, or by agricultural observations such as hyperosmotic stress tolerance or yield. However, any technique can be used to measure the amount of, the comparative level of, or the difference in any selected chemical compound or macromolecule in the transgenic plants.

As used herein an "enhanced trait" means a characteristic of a plant resulting from mutations in a LRR-RLK gene(s) as described herein. Such traits include, but are not limited to, an enhanced agronomic trait characterized by enhanced plant morphology, physiology, growth and development, yield, nutritional enhancement, disease or pest resistance, or environmental or chemical tolerance. In some embodiments, an enhanced trait/altered phenotype may be, for example, decreased days from planting to maturity, increased stalk size, increased number of leaves, increased plant height growth rate in vegetative stage, increased ear size, increased ear dry weight per plant, increased number of kernels per ear, increased weight per kernel, increased number of kernels per plant, decreased ear void, extended grain fill period, reduced plant height, increased number of root branches, increased total root length, drought tolerance, increased water use efficiency, cold tolerance, increased nitrogen use efficiency, and increased yield. In some embodiments, a trait is increased yield under nonstress conditions or increased yield under environmental stress conditions. Stress conditions can include both biotic and abiotic stress, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, plant biomass, pod number, pod position on the plant, number of internodes, incidence of pod shatter, grain size, ear size, ear tip filling, kernel abortion, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), flowering time and duration, ear number, ear size, ear weight, seed number per ear or pod, seed size, composition of seed (starch, oil, protein) and characteristics of seed fill.

Also used herein, the term "trait modification" encompasses altering the naturally occurring trait by producing a detectable difference in a characteristic in a plant comprising a mutation in an endogenous LRR-RLK gene encoding a LRR-RLK polypeptide as described herein relative to a plant not comprising the mutation, such as a wild-type plant, or a negative segregant. In some cases, the trait modification can be evaluated quantitatively. For example, the trait modification can entail an increase or decrease in an observed trait characteristics or phenotype as compared to a control plant. It is known that there can be natural variations in a modified trait. Therefore, the trait modification observed entails a change of the normal distribution and magnitude of the trait characteristics or phenotype in the plants as compared to a control plant.

The present disclosure relates to a plant with improved economically important characteristics, more specifically increased yield. More specifically the present disclosure relates to a plant comprising a mutation(s) in a LRR-RLK gene(s) as described herein, wherein the plant has increased yield as compared to a control plant devoid of said mutation(s). In some embodiments, plants produced as described herein exhibit increased yield or improved yield trait components as compared to a control plant. In some embodiments, a plant of the present disclosure exhibits an improved trait that is related to yield, including but not limited to increased nitrogen use efficiency, increased nitrogen stress tolerance, increased water use efficiency and increased drought tolerance, as defined and discussed infra.

Yield can be defined as the measurable produce of economic value from a crop. Yield can be defined in the scope of quantity and/or quality. Yield can be directly dependent on several factors, for example, the number and size of organs, plant architecture (such as the number of branches, plant biomass, e.g., increased root biomass, steeper root angle and/or longer roots, and the like), flowering time and duration, grain fill period. Root architecture and development, photosynthetic efficiency, nutrient uptake, stress tolerance, early vigor, delayed senescence and functional stay green phenotypes may be factors in determining yield. Optimizing the above-mentioned factors can therefore contribute to increasing crop yield.

Reference herein to an increase/improvement in yield-related traits can also be taken to mean an increase in biomass (weight) of one or more parts of a plant, which can include above ground and/or below ground (harvestable) plant parts. In particular, such harvestable parts are seeds, and performance of the methods of the disclosure results in plants with increased yield and in particular increased seed yield relative to the seed yield of suitable control plants. The term "yield" of a plant can relate to vegetative biomass (root and/or shoot biomass), to reproductive organs, and/or to propagules (such as seeds) of that plant.

Increased yield of a plant of the present disclosure can be measured in a number of ways, including test weight, seed number per plant, seed weight, seed number per unit area (for example, seeds, or weight of seeds, per acre), bushels per acre, tons per acre, or kilo per hectare. Increased yield can result from improved utilization of key biochemical compounds, such as nitrogen, phosphorous and carbohydrate, or from improved responses to environmental stresses, such as cold, heat, drought, salt, shade, high plant density, and attack by pests or pathogens.

"Increased yield" can manifest as one or more of the following: (i) increased plant biomass (weight) of one or more parts of a plant, particularly aboveground (harvestable) parts, of a plant, increased root biomass (increased number of roots, increased root thickness, increased root length) or increased biomass of any other harvestable part; or (ii) increased early vigor, defined herein as an improved seedling aboveground area approximately three weeks post-germination.

"Early vigor" refers to active healthy plant growth especially during early stages of plant growth, and can result from increased plant fitness due to, for example, the plants being better adapted to their environment (for example, optimizing the use of energy resources, uptake of nutrients and partitioning carbon allocation between shoot and root). Early vigor, for example, can be a combination of the ability of seeds to germinate and emerge after planting and the ability of the young plants to grow and develop after emergence. Plants having early vigor also show increased seedling survival and better establishment of the crop, which often results in highly uniform fields with the majority of the plants reaching the various stages of development at substantially the same time, which often results in increased yield. Therefore, early vigor can be determined by measuring various factors, such as kernel weight, percentage germination, percentage emergence, seedling growth, seedling height, root length, root and shoot biomass, canopy size and color and others.

Further, increased yield can also manifest as increased total seed yield, which may result from one or more of an increase in seed biomass (seed weight) due to an increase in the seed weight on a per plant and/or on an individual seed basis an increased number of, for example, flowers/panicles per plant; an increased number of pods; an increased number of nodes; an increased number of flowers ("florets") per panicle/plant; increased seed fill rate; an increased number of filled seeds; increased seed size (length, width, area, perimeter), which can also influence the composition of seeds; and/or increased seed volume, which can also influence the composition of seeds. In one embodiment, increased yield can be increased seed yield, for example, increased seed weight; increased number of filled seeds; and increased harvest index.

Increased yield can also result in modified architecture, or can occur because of modified plant architecture.

Increased yield can also manifest as increased harvest index, which is expressed as a ratio of the yield of harvestable parts, such as seeds, over the total biomass The disclosure also extends to harvestable parts of a plant such as, but not limited to, seeds, leaves, fruits, flowers, bolls, pods, siliques, nuts, stems, rhizomes, tubers and bulbs. The disclosure furthermore relates to products derived from a harvestable part of such a plant, such as dry pellets, powders, oil, fat and fatty acids, starch or proteins.

The present disclosure provides a method for increasing "yield" of a plant or "broad acre yield" of a plant or plant part defined as the harvestable plant parts per unit area, for example seeds, or weight of seeds, per acre, pounds per acre, bushels per acre, tones per acre, tons per acre, kilo per hectare.

As used herein "nitrogen use efficiency" refers to the processes which lead to an increase in the plant's yield, biomass, vigor, and growth rate per nitrogen unit applied. The processes can include the uptake, assimilation, accumulation, signaling, sensing, retranslocation (within the plant) and use of nitrogen by the plant.

As used herein "increased nitrogen use efficiency" refers to the ability of plants to grow, develop, or yield faster or better than normal when subjected to the same amount of available/applied nitrogen as under normal or standard conditions; ability of plants to grow, develop, or yield normally, or grow, develop, or yield faster or better when subjected to less than optimal amounts of available/applied nitrogen, or under nitrogen limiting conditions.

As used herein "nitrogen limiting conditions" refers to growth conditions or environments that provide less than optimal amounts of nitrogen needed for adequate or successful plant metabolism, growth, reproductive success and/or viability.

As used herein the "increased nitrogen stress tolerance" refers to the ability of plants to grow, develop, or yield normally, or grow, develop, or yield faster or better when subjected to less than optimal amounts of available/applied nitrogen, or under nitrogen limiting conditions.

Increased plant nitrogen use efficiency can be translated in the field into either harvesting similar quantities of yield, while supplying less nitrogen, or increased yield gained by supplying optimal/sufficient amounts of nitrogen. The increased nitrogen use efficiency can improve plant nitrogen stress tolerance and can also improve crop quality and biochemical constituents of the seed such as protein yield and oil yield. The terms "increased nitrogen use efficiency", "enhanced nitrogen use efficiency", and "nitrogen stress tolerance" are used inter-changeably in the present disclosure to refer to plants with improved productivity under nitrogen limiting conditions.

As used herein "water use efficiency" refers to the amount of carbon dioxide assimilated by leaves per unit of water vapor transpired. It constitutes one of the most important traits controlling plant productivity in dry environments. "Drought tolerance" refers to the degree to which a plant is adapted to arid or drought conditions. The physiological responses of plants to a deficit of water include leaf wilting, a reduction in leaf area, leaf abscission, and the stimulation of root growth by directing nutrients to the underground parts of the plants. Typically, plants are more susceptible to drought during flowering and seed development (the reproductive stages), as plant's resources are deviated to support root growth. In addition, abscisic acid (ABA), a plant stress hormone, induces the closure of leaf stomata (microscopic pores involved in gas exchange), thereby reducing water loss through transpiration, and decreasing the rate of photosynthesis. These responses improve the water-use efficiency of the plant on the short term. The terms "increased water use efficiency", "enhanced water use efficiency", and "increased drought tolerance" are used inter-changeably in the present disclosure to refer to plants with improved productivity under water-limiting conditions.

As used herein "increased water use efficiency" refers to the ability of plants to grow, develop, or yield faster or better than normal when subjected to the same amount of available/applied water as under normal or standard conditions; ability of plants to grow, develop, or yield normally, or grow, develop, or yield faster or better when subjected to reduced amounts of available/applied water (water input) or under conditions of water stress or water deficit stress.

As used herein "increased drought tolerance" refers to the ability of plants to grow, develop, or yield normally, or grow, develop, or yield faster or better than normal when subjected to reduced amounts of available/applied water and/or under conditions of acute or chronic drought; ability of plants to grow, develop, or yield normally when subjected to reduced amounts of available/applied water (water input) or under conditions of water deficit stress or under conditions of acute or chronic drought.

As used herein, "drought stress" refers to a period of dryness (acute or chronic/prolonged) that results in water deficit and subjects a plant(s) to stress and/or damage to plant tissues and/or negatively affects grain/crop yield; a period of dryness (acute or chronic/prolonged) that results in water deficit and/or higher temperatures and subjects a plant to stress and/or damage to plant tissues and/or negatively affects grain/crop yield.

As used herein, "water deficit" refers to the conditions or environments that provide less than optimal amounts of water needed for adequate/successful growth and development of plants.

As used herein, "water stress" refers to the conditions or environments that provide improper (either less/insufficient or more/excessive) amounts of water than that needed for adequate/successful growth and development of plants/crops thereby subjecting the plants to stress and/or damage to plant tissues and/or negatively affecting grain/crop yield.

As used herein "water deficit stress" refers to the conditions or environments that provide less/insufficient amounts of water than that needed for adequate/successful growth and development of plants/crops thereby subjecting the plants to stress and/or damage to plant tissues and/or negatively affecting grain yield.

As used herein, the terms "nucleic acid," "nucleic acid molecule," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "nucleic acid construct," "oligonucleotide" and "polynucleotide" are also used interchangeably herein to refer to a heteropolymer of nucleotides. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end of the polynucleotide. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end of the polynucleotide. Thus, for example, an element in the 3' region of a polynucleotide can be located anywhere from the first nucleotide located at the 3' end of the polynucleotide to the nucleotide located halfway through the polynucleotide.

As used herein with respect to nucleic acids, the term "fragment" or "portion" refers to a nucleic acid that is reduced in length relative (e.g., reduced by 1, 2, 3, 4, 5, 6, 7, 8, 9, 10, 11, 12, 13, 14, 15, 16, 17, 18, 19, 20, 20, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 400, 450, 500, 550, 600, 650, 700, 750, 800, 850, or 900 or more nucleotides or any range or value therein) to a reference nucleic acid and that comprises, consists essentially of and/or consists of a nucleotide sequence of contiguous nucleotides identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to a corresponding portion of the reference nucleic acid. Such a nucleic acid fragment may be, where appropriate, included in a larger polynucleotide of which it is a constituent. As an example, a repeat sequence of guide nucleic acid of this invention may comprise a "portion" of a wild type CRISPR-Cas repeat sequence (e.g., a wild Type CRISR-Cas repeat; e.g., a repeat from the CRISPR Cas system of, for example, a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or a Cas14c, and the like).

In some embodiments, a fragment or a portion of a LRR-RLK nucleic acid may comprise, consist essentially of or consist of about 10, 20, 30, 40, 50, 60, 70, 80, 90, 100, 120, 130, 140, 150, 160, 170, 180, 190, 200, 220, 240, 260, 280, 300, 320, 340, 360, 380, 400, 420, 440, 460, 480, or 500 consecutive nucleotides or any range or value therein of a nucleic acid encoding a LRR-RLK polypeptide, optionally a fragment or a portion of a LRR-RIK gene may be about 10, 20, 30, 40, 50, 90, 100 to about 200, 300, 400, or 500 consecutive nucleotides in length, about 100 to about 500 consecutive nucleotides in length, about 150 to about 500 consecutive nucleotides in length, about 200 to about 500 consecutive nucleotides in length, about 250 to about 500 consecutive nucleotides in length, about 300 to about 400 consecutive nucleotides in length, about 200 to about 300 consecutive nucleotides in length, about 100 to about 200 consecutive nucleotides in length, about 100 to about 150 consecutive nucleotides in length, about 50 to about 100 consecutive nucleotides in length, about 10 to about 50 consecutive nucleotides in length, or any range or value therein.

In some embodiments, a "sequence-specific nucleic acid binding domain" or "sequence specific DNA binding domain" may bind to one or more fragments or portions of nucleotide sequences encoding LRR-RLK polypeptides as described herein.

As used herein with respect to polypeptides, the term "fragment" or "portion" may refer to a polypeptide that is reduced in length relative to a reference polypeptide and that comprises, consists essentially of and/or consists of an amino acid sequence of contiguous amino acids identical or almost identical (e.g., 90%, 91%, 92%, 93%, 94%, 95%, 96%, 97%, 98%, 99% identical) to a corresponding portion of the reference polypeptide. Such a polypeptide fragment may be, where appropriate, included in a larger polypeptide of which it is a constituent. In some embodiments, the polypeptide fragment comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 260, 270, 280, 290, or more consecutive amino acids of a reference polypeptide. In some embodiments, a fragment or portion of a LRR-RLK polypeptide may comprise, consist essentially of or consist of about 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90, 95, 100, 110, 120, 130, 140, 150, 160, 170, 180, 190, 195, 196, 197, 198, 199, 200, 201, 202, 203, 204, 205, 206, 207, 208, 209, 210, 211, 212, 213, 214, 215, 216, 217, 218, 219, 220, 221, 22, 223, 224, 225, 226, 227, 228, 229, 230, 235, 240, 245, 250, 255, 260, 265, 270, 275, 280, 285, 290, 295, 300, 305, 310, 315, 320, 325, 330, 335, 340, 345, 350, 355, 360, 365, 370, 375, 380, 385, 390, 395, 400, 450, 500, 550, 600, 650, 700, 750, 800, 850, 860, 870, 880, 890, 900, 910, or 920, or more consecutive amino acid residues, or any range or value therein, (e.g., a fragment or a portion of any one of SEQ ID NOs: 86-100 (e.g., SEQ ID NOs: 123-179)).

As used herein with respect to nucleic acids, the term "functional fragment" refers to nucleic acid that encodes a functional fragment of a polypeptide.

The term "gene," as used herein, refers to a nucleic acid molecule capable of being used to produce mRNA, antisense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

The term "mutation" refers to point mutations (e.g., missense, or nonsense, or insertions or deletions of single base pairs that result in frame shifts), insertions, deletions, and/or truncations. When the mutation is a substitution of a residue within an amino acid sequence with another residue, or a deletion or insertion of one or more residues within a sequence, the mutations are typically described by identifying the original residue followed by the position of the residue within the sequence and by the identity of the newly substituted residue. A truncation can include a truncation at the C-terminal end of a polypeptide or at the N-terminal end of a polypeptide. A truncation of a polypeptide can be the result of a deletion of the corresponding 5' end or 3' end of the gene encoding the polypeptide. A frameshift mutation can occur when deletions or insertions of one or more base pairs are introduced into a gene. Frameshift mutations in a gene can result in the production of a polypeptide that is longer, shorter or the same length as the wild type polypeptide depending on when the first stop codon occurs following the mutated region of the gene.

In some embodiments, a deletion useful with this invention may result in an in-frame mutation. In some embodiments, such a deletion may be a dominant negative mutation, a semi-dominant mutation, a hypomorphic mutation, a weak loss-of-function mutation or a null allele, which when comprised in a plant can result in the plant exhibiting increased kernel row number (optionally without substantially decreasing the length of the ear) as compared to a plant not comprising said deletion. A LRR-LRK gene may be edited in more than one location, thereby providing a LRR-LRK gene comprising more than one mutation (e.g., more than one deletion, insertion, substitution or any combination thereof). In some embodiments, such a plant may also exhibit larger meristems, maintenance of root meristems and increased yield and increased disease resistance. Additional advantages of the present invention include, but are not limited to regulating growth, regulating meristem size, regulating vascular development, controlling organ number, facilitating increased plant regeneration from tissue culture, increasing fruit size and or controlling plant secondary growth. A deletion useful with this invention may be, for example, about 1 nucleotide to about 50 consecutive nucleotides in length (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 nucleotides in length).

The terms "complementary" or "complementarity," as used herein, refer to the natural binding of polynucleotides under permissive salt and temperature conditions by base-pairing. For example, the sequence "A-G-T" (5' to 3') binds to the complementary sequence "T-C-A" (3' to 5'). Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement," as used herein, can mean 100% complementarity with the comparator nucleotide sequence or it can mean less than 100% complementarity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity) to the comparator nucleotide sequence.

Different nucleic acids or proteins having homology are referred to herein as "homologues." The term homologue includes homologous sequences from the same and from other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to said nucleotide sequence of the invention.

As used herein "sequence identity" refers to the extent to which two optimally aligned polynucleotide or polypeptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part* I (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent sequence identity" can refer to the percentage of identical amino acids in an amino acid sequence as compared to a reference polypeptide.

As used herein, the phrase "substantially identical," or "substantial identity" in the context of two nucleic acid molecules, nucleotide sequences, or polypeptide sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% nucleotide or amino acid residue identity, when compared and aligned for maximum correspondence, as measured using one of the following sequence comparison algorithms or by visual inspection. In some embodiments of the invention, the substantial identity exists over a region of consecutive nucleotides of a nucleotide sequence of the invention that is about 10 nucleotides to about 20 nucleotides, about 10 nucleotides to about 25 nucleotides, about 10 nucleotides to about 30 nucleotides, about 15 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, about 100 nucleotides to about 200 nucleotides, about 100 nucleotides to about 300 nucleotides, about 100 nucleotides to about 400 nucleotides, about 100 nucleotides to about 500 nucleotides, about 100 nucleotides to about 600 nucleotides, about 100 nucleotides to about 800 nucleotides, about 100 nucleotides to about 900 nucleotides, about 100, 200, 300, 400 consecutive nucleotides to about 500, 600, 700, 800, 1000, 1100, 1200 consecutive nucleotides or more, or any range therein, up to the full length of the sequence. In some embodiments, nucleotide sequences can be substantially identical over at least about 20 consecutive nucleotides (e.g., about 20, 21, 22, 23, 24, 25, 26, 27, 28, 29, 30, 31, 32, 33, 34, 35, 36, 37, 38, 39, 40, 50, 60, 70, or 80 or more consecutive nucleotides).

In some embodiments of the invention, the substantial identity exists over a region of consecutive amino acid residues of a polypeptide of the invention that is about 3 amino acid residues to about 20 amino acid residues, about 5 amino acid residues to about 25 amino acid residues, about 7 amino acid residues to about 30 amino acid residues, about 10 amino acid residues to about 25 amino acid residues, about 15 amino acid residues to about 30 amino acid residues, about 20 amino acid residues to about 40 amino acid residues, about 25 amino acid residues to about 40 amino acid residues, about 25 amino acid residues to about 50 amino acid residues, about 30 amino acid residues to about 50 amino acid residues, about 40 amino acid residues to about 50 amino acid residues, about 40 amino acid residues to about 70 amino acid residues, about 50 amino acid residues to about 70 amino acid residues, about 50 amino acid residues to about 100 amino acid residues, about 60 amino acid residues to about 80 amino acid residues, about 60 amino acid residues to about 100 amino acid residues, about 70 amino acid residues to about 80 amino acid residues, about 70 amino acid residues to about 100 amino acid residues, about 90 amino acid residues to about 100 amino acid residues, or more amino acid residues in length, and any range therein, up to the full length of the sequence. In some embodiments, polypeptide sequences can be substantially identical to one another over at least about 4 consecutive amino acid residues (e.g., about 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 130, 140, 150, 175, 200, 225, 250, 300, 350 or more amino acids in length or more consecutive amino acid residues). In some embodiments, two or more LRR-LRK polypeptides may be identical or substantially identical (e.g., at least 70% to 99.9% identical, e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%. 99.9% identical or any range or value therein).

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters. Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, CA). An "identity fraction" for aligned segments of a test sequence and a reference sequence is the number of identical components which are shared by the two aligned sequences divided by the total number of components in the reference sequence segment, e.g., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Two nucleotide sequences may also be considered substantially complementary when the two sequences hybridize to each other under stringent conditions. In some embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent and are different under different environmental parameters. An extensive guide to the hybridization of nucleic acids is found in Tijssen *Laboratory Techniques in Biochemistry and Molecular Biology-Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point (Tm) for the specific sequence at a defined ionic strength and pH.

The Tm is the temperature (under defined ionic strength and pH) at which 50% of the target sequence hybridizes to a perfectly matched probe. Very stringent conditions are selected to be equal to the Tm for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2x (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

A polynucleotide and/or recombinant nucleic acid construct of this invention (e.g., expression cassettes and/or vectors) may be codon optimized for expression. In some embodiments, the polynucleotides, nucleic acid constructs, expression cassettes, and/or vectors of the editing systems of the invention (e.g., comprising/encoding a sequence-specific nucleic acid binding domain (e.g., a sequence-specific nucleic acid binding domain from a polynucleotide-guided endonuclease, a zinc finger nuclease, a transcription activator-like effector nuclease (TALEN), an Argonaute protein, and/or a CRISPR-Cas endonuclease (e.g., CRISPR-Cas effector protein) (e.g., a Type I CRISPR-Cas effector protein, a Type II CRISPR-Cas effector protein, a Type III CRISPR-Cas effector protein, a Type IV CRISPR-Cas effector protein, a Type V CRISPR-Cas effector protein or a Type VI CRISPR-Cas effector protein)), a nuclease (e.g., an endonuclease (e.g., Fok1), a polynucleotide-guided endonuclease, a CRISPR-Cas endonuclease (e.g., CRISPR-Cas effector protein), a zinc finger nuclease, and/or a transcription activator-like effector nuclease (TALEN)), deaminase proteins/domains (e.g., adenine deaminase, cytosine deaminase), a polynucleotide encoding a reverse transcriptase protein or domain, a polynucleotide encoding a 5'-3' exonuclease polypeptide, and/or affinity polypeptides, peptide tags, etc.) may be codon optimized for expression in a plant. In some embodiments, the codon optimized nucleic acids, polynucleotides, expression cassettes, and/or vectors of the invention have about 70% to about 99.9% (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%. 99.9% or 100%) identity or more to the reference nucleic acids, polynucleotides, expression cassettes, and/or vectors that have not been codon optimized.

In any of the embodiments described herein, a polynucleotide or nucleic acid construct of the invention may be operatively associated with a variety of promoters and/or other regulatory elements for expression in a plant and/or a cell of a plant. Thus, in some embodiments, a polynucleotide or nucleic acid construct of this invention may further comprise one or more promoters, introns, enhancers, and/or terminators operably linked to one or more nucleotide sequences. In some embodiments, a promoter may be operably associated with an intron (e.g., Ubi1 promoter and intron). In some embodiments, a promoter associated with an intron may be referred to as a "promoter region" (e.g., Ubi1 promoter and intron).

By "operably linked" or "operably associated" as used herein in reference to polynucleotides, it is meant that the indicated elements are functionally related to each other and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, nucleic acid sequences can be present between a promoter and the nucleotide sequence, and the promoter can still be considered "operably linked" to the nucleotide sequence.

As used herein, the term "linked," in reference to polypeptides, refers to the attachment of one polypeptide to another. A polypeptide may be linked to another polypeptide (at the N-terminus or the C-terminus) directly (e.g., via a peptide bond) or through a linker.

The term "linker" is art-recognized and refers to a chemical group, or a molecule linking two molecules or moieties, e.g., two domains of a fusion protein, such as, for example, a nucleic acid binding polypeptide or domain and peptide tag and/or a reverse transcriptase and an affinity polypeptide that binds to the peptide tag; or a DNA endonuclease polypeptide or domain and peptide tag and/or a reverse transcriptase and an affinity polypeptide that binds to the peptide tag. A linker may be comprised of a single linking molecule or may comprise more than one linking molecule. In some embodiments, the linker can be an organic molecule, group, polymer, or chemical moiety such as a bivalent organic moiety. In some embodiments, the linker may be an amino acid, or it may be a peptide. In some embodiments, the linker is a peptide.

In some embodiments, a peptide linker useful with this invention may be about 2 to about 100 or more amino acids in length, for example, about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 2 to about 40, about 2 to about 50, about 2 to about 60, about 4 to about 40, about 4 to about 50, about 4 to about 60, about 5 to about 40, about 5 to about 50, about 5 to about 60, about 9 to about 40, about 9 to about 50, about 9 to about 60, about 10 to about 40, about 10 to about 50, about 10 to about 60, or about 2, 3, 4, 5, 6, 7, 8, 9, 10, 11, 12, 13, 14, 15, 16, 17, 18, 19, 20, 21, 22, 23, 24, 25 amino acids to about 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 105, 110, 115, 120, 130, 140 150 or more amino acids in length). In some embodiments, a peptide linker may be a GS linker.

As used herein, the term "linked," or "fused" in reference to polynucleotides, refers to the attachment of one polynucleotide to another. In some embodiments, two or more polynucleotide molecules may be linked by a linker that can be an organic molecule, group, polymer, or chemical moiety such as a bivalent organic moiety. A polynucleotide may be linked or fused to another polynucleotide (at the 5' end or the 3' end) via a covalent or non-covenant linkage or binding, including e.g., Watson-Crick base-pairing, or through one or more linking nucleotides. In some embodiments, a polynucleotide motif of a certain structure may be inserted within another polynucleotide sequence (e.g., extension of the hairpin structure in the guide RNA). In some embodiments, the linking nucleotides may be naturally occurring nucleotides. In some embodiments, the linking nucleotides may be non-naturally occurring nucleotides.

A "promoter" is a nucleotide sequence that controls or regulates the transcription of a nucleotide sequence (e.g., a coding sequence) that is operably associated with the promoter. The coding sequence controlled or regulated by a promoter may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. A promoter may comprise other elements that act as regulators of gene expression; e.g., a promoter region. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in *Genetic Engineering of Plants*, T. Kosuge, C. Meredith and A. Hollaender (eds.), Plenum Press, pp. 211-227).

Promoters useful with this invention can include, for example, constitutive, inducible, temporally regulated, developmentally regulated, chemically regulated, tissue-preferred and/or tissue-specific promoters for use in the preparation of recombinant nucleic acid molecules, e.g., "synthetic nucleic acid constructs" or "protein-RNA complex." These various types of promoters are known in the art.

The choice of promoter may vary depending on the temporal and spatial requirements for expression, and also may vary based on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a promoter functional in a plant may be used with the constructs of this invention. Non-limiting examples of a promoter useful for driving expression in a plant include the promoter of the RubisCo small subunit gene 1 (PrbcS1), the promoter of the actin gene (Pactin), the promoter of the nitrate reductase gene (Pnr) and the promoter of duplicated carbonic anhydrase gene 1 (Pdca1) (See, Walker et al. *Plant Cell Rep.* 23:727-735 (2005); Li et al. Gene 403:132-142 (2007); Li et al. *Mol Biol. Rep.* 37:1143-1154 (2010)). PrbcS1 and Pactin are constitutive promoters and Pnr and Pdca1 are inducible promoters. Pnr is induced by nitrate and repressed by ammonium (Li et al. Gene 403:132-142 (2007)) and Pdca1 is induced by salt (Li et al. *Mol Biol. Rep.* 37:1143-1154 (2010)). In some embodiments, a promoter useful with this invention is RNA polymerase II (Pol II) promoter. In some embodiments, a U6 promoter or a 7SL promoter from *Zea mays* may be useful with constructs of this invention. In some embodiments, the U6c promoter and/or 7SL promoter from *Zea mays* may be useful for driving expression of a guide nucleic acid. In some embodiments, a U6c promoter, U6i promoter and/or 7SL promoter from *Glycine max* may be useful with constructs of this invention. In some embodiments, the U6c promoter, U6i promoter and/or 7SL promoter from *Glycine max* may be useful for driving expression of a guide nucleic acid.

Examples of constitutive promoters useful for plants include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) Nature 313:810-812), CaMV 19S promoter (Lawton et al. (1987) *Plant Mol. Biol.* 9:315-324), nos promoter (Ebert et al. (1987) Proc. Natl. Acad. Sci USA 84:5745-5749), Adh promoter (Walker et al. (1987) *Proc. Natl. Acad. Sci. USA* 84:6624-6629), sucrose synthase promoter (Yang & Russell (1990) Proc. Natl. Acad. Sci. USA 87:4144-4148), and the ubiquitin promoter. The constitutive promoter derived from ubiquitin accumulates in many cell types. Ubiquitin promoters have been cloned from several plant species for use in transgenic plants, for example, sunflower (Binet et al., 1991. *Plant Science* 79:87-94), maize (Christensen et al., 1989. *Plant Molec. Biol.* 12:619-632), and *arabidopsis* (Norris et al. 1993. *Plant Molec. Biol.* 21:895-906). The maize ubiquitin promoter (UbiP) has been developed in transgenic monocot systems and its sequence and vectors constructed for monocot transformation are disclosed in the patent publication EP 0 342 926. The ubiquitin promoter is suitable for the expression of the nucleotide sequences of the invention in transgenic plants, especially monocotyledons. Further, the promoter expression cassettes described by McElroy et al. (*Mol. Gen. Genet.* 231:150-160 (1991)) can be easily modified for the expression of the nucleotide sequences of the invention and are particularly suitable for use in monocotyledonous hosts.

In some embodiments, tissue specific/tissue preferred promoters can be used for expression of a heterologous polynucleotide in a plant cell. Tissue specific or preferred expression patterns include, but are not limited to, green tissue specific or preferred, root specific or preferred, stem specific or preferred, flower specific or preferred or pollen specific or preferred. Promoters suitable for expression in green tissue include many that regulate genes involved in photosynthesis and many of these have been cloned from both monocotyledons and dicotyledons. In one embodiment, a promoter useful with the invention is the maize PEPC promoter from the phosphoenol carboxylase gene (Hudspeth & Grula, *Plant Molec. Biol.* 12:579-589 (1989)). Non-limiting examples of tissue-specific promoters include those associated with genes encoding the seed storage proteins (such as β-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) *Seed Sci. Res.* 1:209-219; as well as EP U.S. Pat. No. 255,378). Tissue-specific or tissue-preferential promoters useful for the expression of the nucleotide sequences of the invention in plants, particularly maize, include but are not limited to those that direct expression in root, pith, leaf or pollen. Such promoters are disclosed, for example, in WO 93/07278, herein incorporated by reference in its entirety. Other non-limiting examples of tissue specific or tissue preferred promoters useful with the invention the cotton rubisco promoter disclosed in U.S. Pat. No. 6,040,504; the rice sucrose synthase promoter disclosed in U.S. Pat. No. 5,604,121; the root specific promoter described by de Framond (FEBS 290:103-106 (1991); EP 0 452 269 to Ciba-Geigy); the stem specific promoter described in U.S. Pat. No. 5,625,136 (to Ciba-Geigy) and which drives expression of the maize trpA gene; the cestrum yellow leaf curling virus promoter disclosed in WO 01/73087; and pollen specific or preferred promoters including, but not limited to, ProOsLPS10 and ProOsLPS11 from rice (Nguyen et al. *Plant Biotechnol. Reports* 9 (5): 297-306 (2015)), ZmSTK2_USP from maize (Wang et al. *Genome* 60 (6): 485-495 (2017)), LAT52 and LAT59 from tomato (Twell et al. *Development* 109 (3): 705-713 (1990)), Zm13 (U.S. Pat. No. 10,421,972), PLA2-8 promoter from *arabidopsis* (U.S. Pat. No. 7,141,424), and/or the ZmCS promoter from maize (International PCT Publication No. WO1999/042587.

Additional examples of plant tissue-specific/tissue preferred promoters include, but are not limited to, the root hair-specific cis-elements (RHEs) (Kim et al. *The Plant Cell* 18:2958-2970 (2006)), the root-specific promoters RCc3 (Jeong et al. *Plant Physiol.* 153:185-197 (2010)) and RB7 (U.S. Pat. No. 5,459,252), the lectin promoter (Lindstrom et al. (1990) *Der. Genet.* 11:160-167; and Vodkin (1983) *Prog. Clin. Biol. Res.* 138:87-98), corn alcohol dehydrogenase 1 promoter (Dennis et al. (1984) *Nucleic Acids Res.* 12:3983-4000), S-adenosyl-L-methionine synthetase (SAMS) (Vander Mijnsbrugge et al. (1996) *Plant and Cell Physiology*, 37 (8): 1108-1115), corn light harvesting complex promoter (Bansal et al. (1992) Proc. Natl. Acad. Sci. USA 89:3654-3658), corn heat shock protein promoter (O'Dell et al. (1985) *EMBO J.* 5:451-458; and Rochester et al. (1986) *EMBO J.* 5:451-458), pea small subunit RuBP carboxylase promoter (Cashmore, "Nuclear genes encoding the small subunit of ribulose-1,5-bisphosphate carboxylase" pp. 29-39

In: *Genetic Engineering of Plants* (Hollaender ed., Plenum Press 1983; and Poulsen et al. (1986) *Mol. Gen. Genet.* 205:193-200), Ti plasmid mannopine synthase promoter (Langridge et al. (1989) *Proc. Natl. Acad. Sci. USA* 86:3219-3223), Ti plasmid nopaline synthase promoter (Langridge et al. (1989), supra), *petunia* chalcone isomerase promoter (van Tunen et al. (1988) *EMBO J.* 7:1257-1263), bean glycine rich protein 1 promoter (Keller et al. (1989) *Genes Dev.* 3:1639-1646), truncated CaMV 35S promoter (O'Dell et al. (1985) *Nature* 313:810-812), potato patatin promoter (Wenzler et al. (1989) *Plant Mol. Biol.* 13:347-354), root cell promoter (Yamamoto et al. (1990) *Nucleic Acids Res.* 18:7449), maize zein promoter (Kriz et al. (1987) Mol. Gen. Genet. 207:90-98; Langridge et al. (1983) *Cell* 34:1015-1022; Reina et al. (1990) *Nucleic Acids Res.* 18:6425; Reina et al. (1990) *Nucleic Acids Res.* 18:7449; and Wandelt et al. (1989) *Nucleic Acids Res.* 17:2354), globulin-1 promoter (Belanger et al. (1991) *Genetics* 129:863-872), α-tubulin cab promoter (Sullivan et al. (1989) *Mol. Gen. Genet.* 215:431-440), PEPCase promoter (Hudspeth & Grula (1989) *Plant Mol. Biol.* 12:579-589), R gene complex-associated promoters (Chandler et al. (1989) *Plant Cell* 1:1175-1183), and chalcone synthase promoters (Franken et al. (1991) *EMBO J.* 10:2605-2612).

Useful for seed-specific expression is the pea vicilin promoter (Czako et al. (1992) *Mol. Gen. Genet.* 235:33-40; as well as the seed-specific promoters disclosed in U.S. Pat. No. 5,625,136. Useful promoters for expression in mature leaves are those that are switched at the onset of senescence, such as the SAG promoter from *Arabidopsis* (Gan et al. (1995) *Science* 270:1986-1988).

In addition, promoters functional in chloroplasts can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

Additional regulatory elements useful with this invention include, but are not limited to, introns, enhancers, termination sequences and/or 5' and 3' untranslated regions.

An intron useful with this invention can be an intron identified in and isolated from a plant and then inserted into an expression cassette to be used in transformation of a plant. As would be understood by those of skill in the art, introns can comprise the sequences required for self-excision and are incorporated into nucleic acid constructs/expression cassettes in frame. An intron can be used either as a spacer to separate multiple protein-coding sequences in one nucleic acid construct, or an intron can be used inside one protein-coding sequence to, for example, stabilize the mRNA. If they are used within a protein-coding sequence, they are inserted "in-frame" with the excision sites included. Introns may also be associated with promoters to improve or modify expression. As an example, a promoter/intron combination useful with this invention includes but is not limited to that of the maize Ubi1 promoter and intron (see, e.g., SEQ ID NO:21 and SEQ ID NO:22).

Non-limiting examples of introns useful with the present invention include introns from the ADHI gene (e.g., Adh1-S introns 1, 2 and 6), the ubiquitin gene (Ubi1), the RuBisCO small subunit (rbcS) gene, the RuBisCO large subunit (rbcL) gene, the actin gene (e.g., actin-1 intron), the pyruvate dehydrogenase kinase gene (pdk), the nitrate reductase gene (nr), the duplicated carbonic anhydrase gene 1 (Tdca1), the psbA gene, the atpA gene, or any combination thereof.

In some embodiments, a polynucleotide and/or a nucleic acid construct of the invention can be an "expression cassette" or can be comprised within an expression cassette. As used herein, "expression cassette" means a recombinant nucleic acid molecule comprising, for example, a one or more polynucleotides of the invention (e.g., a polynucleotide encoding a sequence-specific nucleic acid binding domain, a polynucleotide encoding a deaminase protein or domain, a polynucleotide encoding a reverse transcriptase protein or domain, a polynucleotide encoding a 5'-3' exonuclease polypeptide or domain, a guide nucleic acid and/or reverse transcriptase (RT) template), wherein polynucleotide(s) is/are operably associated with one or more control sequences (e.g., a promoter, terminator and the like). Thus, in some embodiments, one or more expression cassettes may be provided, which are designed to express, for example, a nucleic acid construct of the invention (e.g., a polynucleotide encoding a sequence-specific nucleic acid binding domain, a polynucleotide encoding a nuclease polypeptide/domain, a polynucleotide encoding a deaminase protein/domain, a polynucleotide encoding a reverse transcriptase protein/domain, a polynucleotide encoding a 5'-3' exonuclease polypeptide/domain, a polynucleotide encoding a peptide tag, and/or a polynucleotide encoding an affinity polypeptide, and the like, or comprising a guide nucleic acid, an extended guide nucleic acid, and/or RT template, and the like). When an expression cassette of the present invention comprises more than one polynucleotide, the polynucleotides may be operably linked to a single promoter that drives expression of all of the polynucleotides or the polynucleotides may be operably linked to one or more separate promoters (e.g., three polynucleotides may be driven by one, two or three promoters in any combination). When two or more separate promoters are used, the promoters may be the same promoter or they may be different promoters. Thus, a polynucleotide encoding a sequence specific nucleic acid binding domain (e.g., a sequence specific DNA binding domain), a polynucleotide encoding a nuclease protein/domain, a polynucleotide encoding a CRISPR-Cas effector protein/domain, a polynucleotide encoding an deaminase protein/domain, a polynucleotide encoding a reverse transcriptase polypeptide/domain (e.g., RNA-dependent DNA polymerase), and/or a polynucleotide encoding a 5'-3' exonuclease polypeptide/domain, a guide nucleic acid, an extended guide nucleic acid and/or RT template when comprised in a single expression cassette may each be operably linked to a single promoter, or separate promoters in any combination.

An expression cassette comprising a nucleic acid construct of the invention may be chimeric, meaning that at least one/one or more of its components is heterologous with respect to at least one of its other components (e.g., a promoter from the host organism operably linked to a polynucleotide of interest to be expressed in the host organism, wherein the polynucleotide of interest is from a different organism than the host or is not normally found in association with that promoter). An expression cassette may also be one that is naturally occurring but has been obtained in a recombinant form useful for heterologous expression.

An expression cassette can optionally include a transcriptional and/or translational termination region (i.e., termination region) and/or an enhancer region that is functional in the selected host cell. A variety of transcriptional terminators and enhancers are known in the art and are available for use in expression cassettes. Transcriptional terminators are responsible for the termination of transcription and correct mRNA polyadenylation. A termination region and/or the enhancer region may be native to the transcriptional initiation region, may be native to, for example, a gene encoding a sequence-specific nucleic acid binding protein, a gene encoding a nuclease, a gene encoding a reverse transcriptase, a gene encoding a deaminase, and the like, or may be native to a host cell, or may be native to another source (e.g., foreign or heterologous to, for example, to a promoter, to a gene encoding a sequence-specific nucleic acid binding protein, a gene encoding a nuclease, a gene encoding a reverse transcriptase, a gene encoding a deaminase, and the like, or to the host cell, or any combination thereof).

An expression cassette of the invention also can include a polynucleotide encoding a selectable marker, which can be used to select a transformed host cell. As used herein, "selectable marker" means a polynucleotide sequence that when expressed imparts a distinct phenotype to the host cell expressing the marker and thus allows such transformed cells to be distinguished from those that do not have the marker. Such a polynucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Many examples of suitable selectable markers are known in the art and can be used in the expression cassettes described herein.

In addition to expression cassettes, the nucleic acid molecules/constructs and polynucleotide sequences described herein can be used in connection with vectors. The term "vector" refers to a composition for transferring, delivering or introducing a nucleic acid (or nucleic acids) into a cell. A vector comprises a nucleic acid construct (e.g., expression cassette(s)) comprising the nucleotide sequence(s) to be transferred, delivered or introduced. Vectors for use in transformation of host organisms are well known in the art. Non-limiting examples of general classes of vectors include viral vectors, plasmid vectors, phage vectors, phagemid vectors, cosmid vectors, fosmid vectors, bacteriophages, artificial chromosomes, minicircles, or *Agrobacterium* binary vectors in double or single stranded linear or circular form which may or may not be self-transmissible or mobilizable. In some embodiments, a viral vector can include, but is not limited, to a retroviral, lentiviral, adenoviral, adeno-associated, or herpes simplex viral vector. A vector as defined herein can transform a prokaryotic or eukaryotic host either by integration into the cellular genome or exist extrachromosomally (e.g., autonomous replicating plasmid with an origin of replication). Additionally, included are shuttle vectors by which is meant a DNA vehicle capable, naturally or by design, of replication in two different host organisms, which may be selected from actinomycetes and related species, bacteria and eukaryotic (e.g., higher plant, mammalian, yeast, or fungal cells). In some embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter and/or other regulatory elements and in the case of cDNA this may be under the control of an appropriate promoter and/or other regulatory elements for expression in the host cell. Accordingly, a nucleic acid or polynucleotide of this invention and/or expression cassettes comprising the same may be comprised in vectors as described herein and as known in the art.

As used herein, "contact," "contacting," "contacted," and grammatical variations thereof, refer to placing the components of a desired reaction together under conditions suitable for carrying out the desired reaction (e.g., transformation, transcriptional control, genome editing, nicking, and/or cleavage). As an example, a target nucleic acid may be contacted with a sequence-specific nucleic acid binding protein (e.g., polynucleotide-guided endonuclease, a CRISPR-Cas endonuclease (e.g., CRISPR-Cas effector protein), a zinc finger nuclease, a transcription activator-like effector nuclease (TALEN) and/or an Argonaute protein)) and a deaminase or a nucleic acid construct encoding the same, under conditions whereby the sequence-specific nucleic acid binding protein, the reverse transcriptase and/or the deaminase are expressed and the sequence-specific nucleic acid binding protein binds to the target nucleic acid, and the reverse transcriptase and/or deaminase may be fused to either the sequence-specific DNA binding protein or recruited to the sequence-specific nucleic acid binding protein (via, for example, a peptide tag fused to the sequence-specific nucleic acid binding protein and an affinity tag fused to the reverse transcriptase and/or deaminase) and thus, the deaminase and/or reverse transcriptase is positioned in the vicinity of the target nucleic acid, thereby modifying the target nucleic acid. Other methods for recruiting reverse transcriptase and/or deaminase may be used that take advantage of other protein-protein interactions, and also RNA-protein interactions and chemical interactions may be used for protein-protein and protein-nucleic acid recruitment.

As used herein, "modifying" or "modification" in reference to a target nucleic acid includes editing (e.g., mutating), covalent modification, exchanging/substituting nucleic acids/nucleotide bases, deleting, cleaving, nicking, and/or altering transcriptional control of a target nucleic acid. In some embodiments, a modification may include one or more single base changes (SNPs) of any type.

"Introducing," "introduce," "introduced" (and grammatical variations thereof) in the context of a polynucleotide of interest means presenting a nucleotide sequence of interest (e.g., polynucleotide, RT template, a nucleic acid construct, and/or a guide nucleic acid) to a plant, plant part thereof, or cell thereof, in such a manner that the nucleotide sequence gains access to the interior of a cell.

The terms "transformation" or transfection" may be used interchangeably and as used herein refer to the introduction of a heterologous nucleic acid into a cell. Transformation of a cell may be stable or transient. Thus, in some embodiments, a host cell or host organism (e.g., a plant) may be stably transformed with a polynucleotide/nucleic acid molecule of the invention. In some embodiments, a host cell or host organism may be transiently transformed with a polynucleotide/nucleic acid molecule of the invention.

"Transient transformation" in the context of a polynucleotide means that a polynucleotide is introduced into the cell and does not integrate into the genome of the cell. By "stably introducing" or "stably introduced" in the context of a polynucleotide introduced into a cell is intended that the introduced polynucleotide is stably incorporated into the genome of the cell, and thus the cell is stably transformed with the polynucleotide. "Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein includes the nuclear and the plastid genome, and therefore includes integration of the nucleic acid into, for example, the chloroplast or mitochondrial genome. Stable transformation as used herein can also refer to a transgene that is maintained extrachromosomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, nucleotide sequences, polynucleotides, nucleic acid constructs, and/or expression cassettes of the invention may be expressed transiently and/or they can be stably incorporated into the genome of the host organism. Thus, in some embodiments, a nucleic acid construct of the invention (e.g., one or more expression cassettes comprising polynucleotides for editing as described herein) may be transiently introduced into a cell with a guide nucleic acid and as such, no DNA is maintained in the cell.

A nucleic acid construct of the invention may be introduced into a plant cell by any method known to those of skill in the art. Non-limiting examples of transformation methods include transformation via bacterial-mediated nucleic acid delivery (e.g., via Agrobacteria), viral-mediated nucleic acid delivery, silicon carbide or nucleic acid whisker-mediated nucleic acid delivery, liposome mediated nucleic acid delivery, microinjection, microparticle bombardment, calcium-phosphate-mediated transformation, cyclodextrin-mediated transformation, electroporation, nanoparticle-mediated transformation, sonication, infiltration, PEG-mediated nucleic acid uptake, as well as any other electrical, chemical, physical (mechanical) and/or biological mechanism that results in the introduction of nucleic acid into the plant cell, including any combination thereof. Procedures for transforming both eukaryotic and prokaryotic organisms are well known and routine in the art and are described throughout the literature (See, for example, Jiang et al. 2013. *Nat. Biotechnol.* 31:233-239; Ran et al. *Nanire Protocols* 8:2281-2308 (2013). General guides to various plant transformation methods known in the art include Miki et al. ("Procedures for Introducing Foreign DNA into Plants" in *Methods in Plant Molecular Biology and Biotechnology*, Glick, B. R. and Thompson, J. E., Eds. (CRC Press, Inc., Boca Raton, 1993), pages 67-88) and Rakowoczy-Trojanowska (*Cell. Mol. Biol. Lett.* 7:849-858 (2002)).

In some embodiments of the invention, transformation of a cell may comprise nuclear transformation. In other embodiments, transformation of a cell may comprise plastid transformation (e.g., chloroplast transformation). In still further embodiments, nucleic acids of the invention may be introduced into a cell via conventional breeding techniques. In some embodiments, one or more of the polynucleotides, expression cassettes and/or vectors may be introduced into a plant cell via *Agrobacterium* transformation.

A polynucleotide therefore can be introduced into a plant, plant part, plant cell in any number of ways that are well known in the art. The methods of the invention do not depend on a particular method for introducing one or more nucleotide sequences into a plant, only that they gain access to the interior the cell. Where more than polynucleotide is to be introduced, they can be assembled as part of a single nucleic acid construct, or as separate nucleic acid constructs, and can be located on the same or different nucleic acid constructs. Accordingly, the polynucleotide can be introduced into the cell of interest in a single transformation event, or in separate transformation events, or, alternatively, a polynucleotide can be incorporated into a plant as part of a breeding protocol.

The present invention provides methods and compositions for reducing the influence of genes that normally act to restrict meristem size to generate plants with larger meristems, to maintain the root meristem, to increase kernel row number (optionally without substantially decreasing the length of the ear, e.g., without decreasing ear length more than 30% as compared to an ear of a plant not comprising the same LRR-RLK mutation) and yield, as well as to improve disease resistance.

The (IVI, CLV2, and CLI'3 genes are part of several overlapping signaling pathways that utilize a similar mechanism to regulate meristem size. Plants express many CLV3-like (CLE) peptides which are sensed by many leucine-rich repeat (LRR) domains, and the downstream signaling regulates a myriad of growth processes in the plant (Fletcher, J.C., *Plants* 7:87 (2018)).

As described herein gene-editing technologies are used to create mutant alleles, including dominant negative, a semi-dominant mutation, a hypomorphic mutation, or a weak loss-of-function mutation, that increase meristem size and yield (see, e.g., FIG. 1). CLV1 has an external LRR domain that interacts with other LRRs including CLV2 to perceive the CLE peptide, and a cytoplasmic kinase domain that mediates signaling by phosphorylating downstream targets. Maize contains several orthologous genes within these LRR-RLK groups, all of which share conserved amino acids in the kinase domain that when mutated could cause a dominant negative effect. FIGS. 2-4 provide alignments of portions of LRR-RLK orthologues from *Arabidopsis* and maize showing shared domains.

Accordingly, as described herein, editing technology is used to target LRR-RLK genes in plants to generate plants with larger meristems, having increased kernel row number (optionally without substantially decreasing the length of the ear), increased yield, and improved disease resistance as well as to generate plants that maintain their root meristem. Mutations that may be useful for production of plants exhibiting increased kernel row number include, for example, substitutions, deletions and insertions. In some aspects, a mutation generated by the editing technology can be a point mutation, an in-frame deletion, a mutation that generates a premature stop codon, a null mutation, a dominant negative mutation, a semi-dominant mutation, hypomorphic mutation, or a weak loss-of-function mutation.

In some embodiments, a mutation is a non-naturally introduced mutation, e.g., a mutation that has not occurred naturally but is introduced by human intervention.

In some embodiments, the invention provides a plant or plant part thereof, the plant or plant part comprising at least one non-naturally introduced mutation (e.g., 1, 2, 3, 4, 5, or more mutations) in an endogenous Leucine Rich Repeat Receptor Like Protein Kinase (LRR-RIK) gene that encodes a LRR-RLK protein. In some embodiments, the at least one non-naturally introduced mutation results in a null mutation, a dominant negative mutation, a semi-dominant mutation, a hypomorphic mutation, and/or a weak loss-of-function mutation.

In some embodiments, a plant cell is provided, the plant cell comprising an editing system comprising: (a) a CRISPR-Cas effector protein; and (b) a guide nucleic acid (gRNA, gDNA, crRNA, crDNA, sgRNA, sgDNA) comprising a spacer sequence with complementarity to an endogenous target gene encoding a LRR-RLK protein. The editing system may be used to generate a mutation in the endogenous target gene encoding a LRR-RLK protein.

In some embodiments, a guide nucleic acid of an editing system may comprise the nucleotide sequence (a spacer sequence) of any one of SEQ ID NOs: 101-117 or SEQ ID NOs: 243-266.

The mutation in a LRR-RLK gene of the plant, plant part thereof or the plant cell may be any type of mutation, including a base substitution, a base deletion and/or a base insertion. In some embodiments, a mutation may comprise a base substitution to an A, a T, a G, or a C. In some embodiments, the at least one mutation may be a base substitution from a C to a T (C>T). In some embodiments, the at least one mutation may be a base substitution from a G to an A (G>A). In some embodiments, the at least one mutation is a clv1-1, clv1-2 or clv1-9 mutation or any combination thereof (see, as an example, a mutation of G856, G881 and A839 of SEQ ID NO:86).

In some embodiments, a non-naturally introduced mutation may be a deletion of at least one base pair (e.g., 1 base pair to about 200 base pairs) or an insertion of at least one base pair (e.g., 1 base pair to about 50 base pairs). In some embodiments, a deletion may comprise 1 base pair to about 10 base pairs (e.g., 1, 2 bp to about 3, 4, 5, 6, 7, 8, 9, or 10 bp; e.g., 1, 2, 3, 4, 5, 6, 7, 8, 9, 10 base pairs), 1 base pair to about 10 to 20 consecutive base pairs (e.g., 1, 2, 3, 4, 56, 7, 8, 9, 101, 12, 13, 14, 15, 16, 17, 18, 19, or 20 consecutive base pairs; e.g., 1, 2 3, 4, 5, 6 bp to about 7, 8, 9, 10, 11, 12, 13, 14, 15, 16, 17, 18, 19, or 20 consecutive base pairs), 1 base pair to about 30 consecutive base pairs, 1 base pair to about 40 consecutive base pairs, 1 base pair to about 50 consecutive base pairs (e.g., 1, 2, 4, 5, 6, 7, 8, 9, 10, 11, 12, 13, 14, 15, 16, 17, 18, 19, 20, 21, 22, 23, 24, 25 consecutive base pairs to about 26, 27, 28, 29, 30, 31, 32, 33, 34, 35, 36, 37, 38, 39, 40, 41, 42, 43, 44, 45, 46, 47, 48, 49, 50 consecutive base pairs), or about 30, 31, 32, 33, 34, 35, 36, 37, 38, 39, 40, 41, 42, 43, 44, 45, 46, 47, 48, 49, 50 consecutive base pairs to about 60, 70, 80, 90, 100, 110, 120, 130, 131, 132, 133, 134, 135, 136, 137, 138, 139, 140, 145, 150, 155, or 160 consecutive base pairs or any value or range therein of a LRR-RLK gene. In some embodiments, a deletion may be an in-frame deletion. In some embodiments, a deletion provides a premature stop codon and a truncated LRR-RLK gene and/or protein.

In some embodiments, a mutation useful with this invention (e.g., a non-naturally introduced mutation) may result in at least one amino acid substitution in a region of a LRR-RIK gene comprising, for example, any one of the amino acid sequences of SEQ ID NOs: 123-179. In some embodiments, a mutation resulting in one or more substituted amino acid residues in a LRR-RLK gene may be a clv-9 mutation that is located: (a) at position 893 with reference to amino acid position numbering of SEQ ID NO:87; (b) at position 187 with reference to amino acid position numbering of SEQ ID NO:88; (c) at position 451 with reference to amino acid position numbering of SEQ ID NO:89; (d) at position 453 with reference to amino acid position numbering of SEQ ID NO:90; (e) at position 468 with reference to amino acid position numbering of SEQ ID NO:91; (f) at position 449 with reference to amino acid position numbering of SEQ ID NO:92; (g) at position 928 with reference to amino acid position numbering of SEQ ID NO:93; (h) at position 857 with reference to amino acid position numbering of SEQ ID NO:94 or SEQ ID NO: 96; (i) at position 853 with reference to amino acid position numbering of SEQ ID NO: 95; (j) at position 827 with reference to amino acid position numbering of SEQ ID NO: 97; (k) at position 844 with reference to amino acid position numbering of SEQ ID NO: 98; (l) at position 835 with reference to amino acid position numbering of SEQ ID NO: 99; (m) at position 840 with reference to amino acid position numbering of SEQ ID NO: 100; or (n) at position 839 with reference to amino acid position numbering of SEQ ID NO: 86. In some embodiments, the clv-9 mutation may be an substitution of an Alanine (A) to a valine (V).

In some embodiments, a mutation resulting in one or more substituted amino acid residues in a LRR-RLK gene may be a clv-1 mutation that is located: (a) at position 918 with reference to amino acid position numbering of SEQ ID NO:87; (b) at position 203 with reference to amino acid position numbering of SEQ ID NO:88; (c) at position 467 with reference to amino acid position numbering of SEQ ID NO:89; (d) at position 469 with reference to amino acid position numbering of SEQ ID NO:90; (e) at position 484 with reference to amino acid position numbering of SEQ ID NO:91; (f) at position 465 with reference to amino acid position numbering of SEQ ID NO:92; (g) at position 944 with reference to amino acid position numbering of SEQ ID NO:93; (h) at position 874 with reference to amino acid position numbering of SEQ ID NO:94 or SEQ ID NO:96; (i) at position 870 with reference to amino acid position numbering of SEQ ID NO:95; (j) at position 845 with reference to amino acid position numbering of SEQ ID NO:97; (k) at position 861 with reference to amino acid position numbering of SEQ ID NO:98; (l) at position 852 with reference to amino acid position numbering of SEQ ID NO:99; (m) at position 857 with reference to amino acid position numbering of SEQ ID NO: 100; or (n) at position 856 with reference to amino acid position numbering of SEQ ID NO:86. In some embodiments, the mutation clv-1 may be an substitution of an Glycine (G) to an aspartic acid (D)

In some embodiments, a mutation resulting in one or more substituted amino acid residues in a LRR-RLK gene may be a clv-2 mutation that is located: (a) at position 918 with reference to amino acid position numbering of SEQ ID NO:87; (b) at position 203 with reference to amino acid position numbering of SEQ ID NO:88; (c) at position 467 with reference to amino acid position numbering of SEQ ID NO:89; (d) at position 469 with reference to amino acid position numbering of SEQ ID NO:90; (e) at position 484 with reference to amino acid position numbering of SEQ ID NO:91; (f) at position 465 with reference to amino acid position numbering of SEQ ID NO:92; (g) at position 944 with reference to amino acid position numbering of SEQ ID NO:93; (h) at position 874 with reference to amino acid position numbering of SEQ ID NO:94 or SEQ ID NO:96; (i) at position 870 with reference to amino acid position numbering of SEQ ID NO:95; (j) at position 845 with reference to amino acid position numbering of SEQ ID NO:97; (k) at position 861 with reference to amino acid position numbering of SEQ ID NO:98; (l) at position 852 with reference to amino acid position numbering of SEQ ID NO:99; (m) at position 857 with reference to amino acid position numbering of SEQ ID NO:100; or (n) at position 856 with reference to amino acid position numbering of SEQ ID NO:86. In some embodiments, the mutation clv-2 may be an substitution of an Glycine (G) to an glutamic acid (E).

In some embodiments, a plant or part thereof of the present invention may comprise a clv-9 mutation, a clv-1 mutation or a clv-2 mutation.

An endogenous LRR-RLK gene (e.g., endogenous target gene) useful with this invention may comprise a sequence having at least 90% sequence identity to any one of the nucleotide sequences of SEQ ID NO: 72-85 and/or may encode LRR-RLK protein comprising (a) a sequence having at least 90% sequence identity to any one of the amino acid sequences of SEQ ID NOs: 86-100; (b) a sequence comprising one or more motifs having (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO: 121), wherein $X_1$=S or T, $X_2$=A, G or S, $X_3$=V or I, $X_4$=A or R, $X_5$=T or S; and/or (c) a region having the sequence of any one of the amino acid sequences of SEQ ID NOs: 123-179. In some embodiments, a mutated LRR-RLK protein comprises at least about 90% sequence identity to any one of the amino acid sequences of SEQ ID NOs: 180-193.

In some embodiments, a plant comprising at least one mutation in an endogenous LRR-RLK gene exhibits increased maintenance of meristems and/or increased kernel row number as compared to a plant without the at least one mutation, optionally without substantially decreasing the length of the ear. In some embodiments, the plant comprising at least one mutation in an endogenous LRR-RLK gene is a corn plant which exhibits increased kernel row number, optionally without substantially decreasing the length of the ear. In some embodiments, the plant comprising at least one mutation in an endogenous LRR-RLK gene is a corn plant which exhibits increased yield and/or increased disease resistance. In some embodiments, a plant (e.g., a corn plant) may be regenerated from a plant part and/or plant cell of the invention, wherein the regenerated plant (e.g., regenerated corn plant) comprises the mutation in the endogenous LRR-RLK gene and a phenotype of increased kernel row number (e.g., produces ears having increased kernel row number) as compared to a plant (e.g., a corn plant) not comprising the mutation (e.g., an isogenic plant not comprising the mutation), optionally without substantially decreasing the length of the ear.

In some embodiments, a corn plant cell is provided, the corn plant cell comprising at least one non-naturally introduced mutation within a LRR-RLK gene, wherein the mutation is a substitution, insertion or a deletion that is introduced using an editing system that comprises a nucleic acid binding domain that binds to a target site in the LRR-RLK gene. In some embodiments, the substitution, insertion or a deletion results in a null allele, a dominant negative allele, a semi-dominant allele, hypomorphic mutation, or a weak loss-of-function allele. In some embodiments, a deletion results in an in-frame deletion allele. In some embodiments, the target site is within a region of the LRR-RLK gene, the region encoding a sequence having at least 90% sequence identity (e.g., about 90, 91, 92, 93, 94, 95, 96, 97, 98, 99, 99.5, 99.6, 99.7, 99.8, 99.9, or 100% sequence identity) to the amino acid sequences of SEQ ID NO:123-179 or the target site comprises a sequence encoding an amino acid sequence having one or more motifs, the one or more motifs defined by (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S. In some embodiments, the at least one mutation results in one or more amino acid substitutions as described herein (e.g., a clv-1, clv-2, clv-9 in an LRR-RLK gene as described herein.

In some embodiments, a method of producing/breeding a transgene-free edited corn plant is provided, the method comprising: crossing a corn plant of the present invention (e.g., a corn plant comprising a mutation in a LRR-RLK gene and having increased kernel row number, optionally having increased kernel row number without substantially decreasing the length of the ear, e.g., a decrease of less than 30%) with a transgene free corn plant, thereby introducing the at least one non-naturally introduced mutation into the corn plant that is transgene-free; and selecting a progeny corn plant that comprises the at least one non-naturally introduced mutation and is transgene-free, thereby producing a transgene free edited corn plant.

Also provided herein is a method of providing a plurality of corn plants having increased kernel row number, the method comprising planting two or more corn plants of the invention (e.g., 2, 3, 4, 5, 6, 7, 8, 9, 10 or more corn plants comprising a mutation in a LRR-RLK polypeptide and having increased kernel row number, optionally without substantially reducing ear length, e.g., a decrease of less than 30%) in a growing area (e.g., a field (e.g., a cultivated field, an agricultural field), a growth chamber, a greenhouse, a recreational area, a lawn, and/or a roadside and the like), thereby providing a plurality of corn plants having increased kernel row number as compared to a plurality of control corn plants not comprising the mutation. In some embodiments, the plurality of plants may also exhibit larger meristems, increased yield, increased disease resistance and maintenance of their root meristems. The invention further provides a method of generating variation in a region of a corn LRR-RLK protein, comprising: introducing an editing system into a corn plant cell, wherein the editing system is targeted to a region of a corn LRR-RLK gene that encodes a portion of the corn LRR-RLK protein, wherein the portion comprises any one of the amino acid sequences of SEQ ID NO:123-179; and contacting the region of the corn LRR-RLK gene with the editing system, thereby introducing into the corn plant cell a mutation into the region of the corn LRR-RLK protein; and generating variation in the region of the LRR-RLK protein. In some embodiments, a method for editing a specific site in the genome of a corn plant cell, the method comprising: cleaving, in a site specific manner, a target site within an endogenous LRR-RLK gene in the corn plant cell, the endogenous LRR-RLK gene: comprising a sequence having at least 90% sequence identity to any one of the nucleotide sequences of SEQ ID NO: 72-85, or encoding: (a) a sequence having at least 90% sequence identity to any one of the amino acid sequences of SEQ ID NOs: 86-100; (b) a sequence comprising one or more motifs having: (i) the sequence of IX$_1$HX$_2$DX$_3$K (SEQ ID NO:118), wherein X$_1$=V, I, or L, X$_2$=R or C and X$_3$=L or V, (ii) the sequence of NXLL (SEQ ID NO:119), wherein X=I or V, (iii) the sequence of DFGLAX$_1$X$_2$L (SEQ ID NO:120) wherein X$_1$=K or R and X$_2$=L or F, (iv) the sequence of DVX$_1$X$_2$X$_3$GX$_4$X$_5$X$_6$EL (SEQ ID NO:122), wherein X$_1$=F or Y, X$_2$=G or S, X$_3$=F, Y or I, X$_4$=I or V, X$_5$=L or V, and X$_6$=L, V or M, and/or (v) the sequence of X$_1$X$_2$X$_3$X$_4$GX$_5$ (SEQ ID NO:121), wherein X$_1$=S or T, X$_2$=A, G or S, X$_3$=V or I, X$_4$=A or R, X$_5$=T or S; and/or (c) a region having the sequence of any one of the amino acid sequences of SEQ ID NOs: 123-179, thereby generating an edit in the endogenous LRR-RLK gene of the corn plant cell and producing a corn plant cell comprising the edit in the endogenous LRR-RLK gene. The endogenous LRR-RLK gene encodes a LRR-LRK protein and the edit results in variation of amino acids in the coding region of the LRR-LRK protein. In some embodiments, the edit results in a non-naturally introduced mutation, including but not limited to a deletion, substitution, or insertion, wherein the edit may result in a null mutation, a dominant negative mutation, a semi-dominant mutation, a hypomorphic mutation, or a weak loss-of-function mutation. In some embodiments, a non-naturally introduced mutation is a base substitution resulting in an amino acid substitution, optionally wherein the substitution is in one or more domains of a LRR-RLK gene, including, but not limited to, one or more domains that comprise any one or more of the amino acid sequences of SEQ ID NOs: 123-127 or SEQ ID NOs: 120-122 as defined herein. In some embodiments, the substitution may result in an edited LRK-RLK gene encoding an amino acid sequence having at least 90% sequence identity to any one of SEQ ID NOs: 180-193. In some embodiments, a non-naturally introduced mutation produces variability in a region of a LRR-RLK polypeptide as set forth herein. In some embodiments, a method of editing may further comprise regenerating a corn plant from the corn plant cell comprising the edit in the endogenous LRR-RLK gene, thereby producing a corn plant comprising the edit in its endogenous LRR-RLK gene and having a phenotype of increased kernel row number when compared to a control corn plant (e.g., an isogenic corn plant) that does not comprise the edit, optionally wherein the increase in kernel row number of the ear does not substantially reduce ear length.

In some embodiments, a method for making a corn plant, comprising: (a) contacting a population of corn plant cells comprising a wild-type endogenous LRR-RLK gene with a nuclease linked to a nucleic acid binding domain (e.g., editing system) that binds to a sequence (1) having at least 90% sequence identity to any one of the nucleotide sequences of SEQ ID NO: 72-85; or (2) encoding (i) a sequence having at least 90% sequence identity to any one of the amino acid sequences of SEQ ID NOs: 86-100; (ii) a sequence comprising one or more motifs having: a) the sequence of IX$_1$HX$_2$DX$_3$K (SEQ ID NO:118), wherein X$_1$=V, I, or L, X$_2$=R or C and X$_3$=L or V, b) the sequence of NXLL (SEQ ID NO:119), wherein X=I or V, c) the sequence of DFGLAX$_1$X$_2$L (SEQ ID NO:120) wherein X$_1$=K or R and X$_2$=L or F, d) the sequence of DVX$_1$X$_2$X$_3$GX$_4$X$_5$LX$_6$EL (SEQ ID NO: 122), wherein X$_1$=F or Y, X$_2$=G or S, X$_3$=F, Y or I, X$_4$=I or V, X$_5$=L or V, and X$_6$=L, V or M, and/or e) the sequence of X$_1$X$_2$X$_3$X$_4$GX$_5$ (SEQ ID NO:121), wherein X$_1$=S or T, X$_2$=A, G or S, X$_3$=V or I, X$_4$=A or R, X$_5$=T or S; and/or (iii) a region having the sequence of any one of the amino acid sequences of SEQ ID NOs: 123-179; (b) selecting a corn plant cell from the population that comprises at least one mutation in the wild-type endogenous LRR-RLK gene, wherein the at least one mutation results in a null allele, a dominant negative allele, a semi-dominant allele, a hypomorphic allele, or a weak loss-of-function allele; and (c) growing the selected plant cell into a corn plant.

In some embodiments, a method increasing kernel row number in a corn plant, comprising (a) contacting a corn plant cell comprising an endogenous LRR-RLK gene with a nuclease targeting the endogenous LRR-RLK gene, wherein the nuclease is linked to a nucleic acid binding domain (e.g., a DNA binding domain, e.g., an editing system) that binds to a target site in the endogenous LRR-RLK gene, wherein the endogenous LRR-RLK gene: (i) comprises a sequence having at least 90% sequence identity to any one of the nucleotide sequences of SEQ ID NO: 72-85; (ii) encodes a sequence having at least 90% sequence identity to any one of the amino acid sequences of SEQ ID NOs: 86-100; (iii) encodes a sequence having at least 90% sequence identity to a sequence comprising one or more motifs having: a) the sequence of IX$_1$HX$_2$DX$_3$K (SEQ ID NO:118), wherein X$_1$=V, I, or L, X$_2$=R or C and X$_3$=L or V, b) the sequence of NXLL (SEQ ID NO:119), wherein X=I or V, c) the sequence of DFGLAX$_1$X$_2$L (SEQ ID NO: 120) wherein X$_1$=K or R and X$_2$=L or F, d) the sequence of DVX$_1$X$_2$X$_3$GX$_4$X$_5$LX$_6$EL (SEQ ID NO:122), wherein X$_1$=F or Y, X$_2$=G or S, X$_3$=F, Y or I, X$_4$=I or V, X$_5$=L or V, and X$_6$=L, V or M, and/or e) the sequence of X$_1$X$_2$X$_3$X$_4$GX$_5$ (SEQ ID NO:121), wherein X$_1$=S or T, X$_2$=A, G or S, X$_3$=V or I, X$_4$=A or R, X$_5$=T or S; and/or (iv) encodes a sequence comprising a region having the sequence of any one of the amino acid sequences of SEQ ID NOs: 123-179 to produce a corn plant cell comprising a mutation in the endogenous LRR-RLK gene, thereby producing the corn plant comprising at least one cell having a mutation in the endogenous LRR-RLK gene; and (b) growing the corn plant cell into a corn plant comprising the mutation in the endogenous LRR-RIK gene, thereby producing a corn plant have a mutated endogenous LRR-RLK gene and an increased kernel row number, optionally without substantially reducing ear length (e.g., a decrease of less than 30%).

In some embodiments, a method for producing a corn plant or part thereof comprising at least one cell having a mutated endogenous LRR-RLK gene, the method comprising contacting a target site in an endogenous LRR-RLK gene in the corn plant or plant part with a nuclease comprising a cleavage domain and a nucleic acid binding domain, wherein the nucleic acid binding domain binds to a target site in the endogenous LRR-RLK gene, wherein the endogenous LRR-RLK gene (a) comprises a sequence having at least 90% sequence identity to any one of the nucleotide sequences of SEQ ID NO: 72-85; (b) encodes a sequence having at least 90% sequence identity to any one of the amino acid sequences of SEQ ID NOs: 86-100; (c) encodes a sequence having at least 90% sequence identity to a sequence comprising one or more motifs having: (i) the sequence of IX$_1$HX$_2$DX$_3$K (SEQ ID NO: 118), wherein X$_1$=V, I, or L, X$_2$=R or C and X$_3$=L or V, (ii) the sequence of NXLL (SEQ ID NO:119), wherein X=I or V, (iii) the sequence of DFGLAX$_1$X$_2$L (SEQ ID NO: 120) wherein X$_1$=K or R and X$_2$=L or F, (iv) the sequence of DVX$_1$X$_2$X$_3$GX$_4$X$_5$LX$_6$EL (SEQ ID NO: 122), wherein X$_1$=F or Y, X$_2$=G or S, X$_3$=F, Y or I, X$_4$=I or V, X$_5$=L or V, and X$_6$=L, V or M, and/or (v) the sequence of X$_1$X$_2$X$_3$X$_4$GX$_5$ (SEQ ID NO:121), wherein X$_1$=S or T, $X_2$=A, G or S, $X_3$=V or I, $X_4$=A or R, $X_5$=T or S; and/or (d) encodes a sequence comprising a region having the sequence of any one of the amino acid sequences of SEQ ID NOs: 123-179 to produce a plant cell comprising a mutation in the endogenous LRR-RLK gene, thereby producing a corn plant or part thereof comprising at least one cell having a mutation in the endogenous LRR-RLK gene.

Also provided herein is a method for producing a corn plant or part thereof comprising a mutated endogenous LRR-RLK gene and exhibiting increased kernel row number, the method comprising contacting a target site in an endogenous LRR-RLK gene in the corn plant or plant part with a nuclease comprising a cleavage domain and a DNA-binding domain, wherein the nucleic acid binding domain binds to a target site in the endogenous LRR-RLK gene, wherein the endogenous LRR-RLK gene (a) comprises a sequence having at least 90% sequence identity to any one of the nucleotide sequences of SEQ ID NO:72-85; (b) encodes a sequence having at least 90% sequence identity to any one of the amino acid sequences of SEQ ID NOs: 86-100; (c) encodes a sequence having at least 90% sequence identity to a sequence comprising one or more motifs having: (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO: 121), wherein $X_1$=S or T, $X_2$=A, G or S, $X_3$=V or I, $X_4$=A or R, $X_5$=T or S; and/or (d) encodes a sequence comprising a region having the sequence of any one of the amino acid sequences of SEQ ID NOs: 123-179, thereby producing the corn plant or part thereof comprising an endogenous LRR-RLK gene having a mutation and exhibiting increased kernel row number, optionally wherein the increase in kernel row number does not substantially reduce ear length.

In some embodiments, a corn plant or part thereof comprising at least one cell having a mutation in the endogenous LRR-RLK gene as described herein encodes a sequence having at least 90% identity to any one of the sequences of SEQ ID NOs: 180-193.

In some embodiments, a nuclease may cleave an endogenous LRR-RLK gene, thereby introducing the mutation into the endogenous LRR-RLK gene. A nuclease useful with the invention may be any nuclease that can be utilized to edit/modify a target nucleic acid. Such nucleases include, but are not limited to a zinc finger nuclease, transcription activator-like effector nucleases (TALEN), endonuclease (e.g. Fok1) and/or a CRISPR-Cas effector protein. Likewise, any nucleic acid binding domain useful with the invention may be any nucleic acid binding domain that can be utilized to edit/modify a target nucleic acid. Such nucleic acid binding domains include, but are not limited to, a zinc finger, transcription activator-like DNA binding domain (TAL), an argonaute and/or a CRISPR-Cas effector DNA binding domain.

In some embodiments, a method of editing an endogenous LRR-RLK gene in a corn plant or plant part is provided, the method comprising contacting a target site in an endogenous LRR-RLK gene in the corn plant or plant part with a cytosine base editing system comprising a cytosine deaminase and a nucleic acid binding domain that binds to a target site in the endogenous LRR-RLK gene, wherein the endogenous LRR-RLK gene (a) comprises a sequence having at least 90% sequence identity to any one of the nucleotide sequences of SEQ ID NO: 72-85; (b) encodes a sequence having at least 90% sequence identity to any one of the amino acid sequences of SEQ ID NOs: 86-100; (c) encodes a sequence having at least 90% sequence identity to a sequence comprising one or more motifs having: (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (d) encodes a sequence comprising a region having the sequence of any one of the amino acid sequences of SEQ ID NOs: 123-179, thereby editing the endogenous LRR-RLK gene in the corn plant or part thereof and producing a corn plant or part thereof comprising at least one cell having a mutation in the endogenous LRR-RLK gene.

In some embodiments, a method of editing an endogenous LRR-RLK gene in a corn plant or plant part is provided, the method comprising contacting a target site in an LRR-RLK gene in the corn plant or plant part with an adenosine base editing system comprising an adenosine deaminase and a nucleic acid binding domain that binds to a target site in the LRR-RIK gene, the LRR-RLK gene (a) comprising a sequence having at least 90% sequence identity to any one of the nucleotide sequences of SEQ ID NO:72-85; (b) encoding a sequence having at least 90% sequence identity to any one of the amino acid sequences of SEQ ID NOs: 86-100; (c) encoding a sequence having at least 90% sequence identity to a sequence comprising one or more motifs having: (i) the $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (d) encoding a sequence comprising a region having the sequence of any one of the amino acid sequences of SEQ ID NOs: 123-179, thereby editing the endogenous LRR-RLK gene in the corn plant or part thereof and producing a plant or part thereof comprising at least one cell having a mutation in the endogenous LRR-RLK gene.

In some embodiments, a mutation in an edited endogenous LRR-RLK gene as described herein results a mutated amino acid sequence having at least 90% identity to any one of the amino acid sequences of SEQ ID NOs: 180-193.

In some embodiments, a method of detecting a mutant LRR-RLK gene (a mutation in an endogenous LRR-RLK gene) is provided, the method comprising detecting in the genome of a plant a substitution in a nucleic acid encoding any one of the amino acid sequences of SEQ ID NOs: 86-100, wherein the mutation is in one or more amino acid residue(s) located (a) at position 893, 918 and/or 943 with reference to amino acid position numbering of SEQ ID NO: 87; (b) at position 187, 203 and/or 228 with reference to amino acid position numbering of SEQ ID NO:88; (c) at position 451, 467 and/or 492 with reference to amino acid position numbering of SEQ ID NO:89; (d) at position 453, 469 and/or 494 with reference to amino acid position numbering of SEQ ID NO:90; (e) at position 468, 484 and/or 509 with reference to amino acid position numbering of SEQ ID NO:91; (f) at position 449, 465, and/or 490 with reference to amino acid position numbering of SEQ ID NO: 92; (g) at position 928, 944, and/or 969 with reference to amino acid position numbering of SEQ ID NO:93; (h) at position 857, 874 and/or 898 with reference to amino acid position numbering of SEQ ID NO:94 or SEQ ID NO:96; (i) at position 853, 870 and/or 894 with reference to amino acid position numbering of SEQ ID NO:95; (j) at position 827, 845 and/or 900 with reference to amino acid position numbering of SEQ ID NO:97; (k) at position 844, 861 and/or 885 with reference to amino acid position numbering of SEQ ID NO: 98; (l) at position 835, 852, and/or 877 with reference to amino acid position numbering of SEQ ID NO:99; (m) at position 840, 857 and/or 881 with reference to amino acid position numbering of SEQ ID NO: 100; or (n) at position 839, 856 and/or 881 with reference to amino acid position numbering of SEQ ID NO:86 . . . . In some embodiments, the mutation is the result of a nucleotide substitution of C>T or G>A.

In some embodiments, the present invention provides a method of detecting a mutation in an endogenous LRR-RLK gene, comprising detecting in the genome of a plant a mutated LRR-RLK gene. In some embodiments, the mutated LRR-RLK gene encodes a sequence having at least 90% sequence identity to the amino acid sequence of any one of SEQ ID NOs: 180-193.

In some embodiments, the present invention provides a method of producing a plant comprising a mutation in an endogenous LRR-RLK gene and at least one polynucleotide of interest, the method comprising crossing a plant of the invention comprising at least one mutation in an endogenous LRR-RLK gene (a first plant) with a second plant that comprises the at least one polynucleotide of interest to produce progeny plants; and selecting progeny plants comprising at least one mutation in the LRR-RLK gene and the at least one polynucleotide of interest, thereby producing the plant comprising a mutation in an endogenous LRR-RLK gene and at least one polynucleotide of interest.

The present invention further provides a method of producing a plant comprising a mutation in an endogenous LRR-RLK gene and at least one polynucleotide of interest, the method comprising introducing at least one polynucleotide of interest into a plant of the present invention comprising at least one mutation in a LRR-RLK gene, thereby producing a plant comprising at least one mutation in a LRR-RLK gene and at least one polynucleotide of interest. In some embodiments, the plant is a corn plant.

A polynucleotide of interest may be any polynucleotide that can confer a desirable phenotype or otherwise modify the phenotype or genotype of a plant. In some embodiments, a polynucleotide of interest may be polynucleotide that confers herbicide tolerance, insect resistance, disease resistance, increased yield, increased nutrient use efficiency or abiotic stress resistance.

A Leucine Rich Repeat Receptor Like Protein Kinase (LRR-RLK) gene useful with this invention includes any LRR-RLK gene in which a mutation as described herein can confer increased kernel row number in a plant or part thereof comprising the mutation (e.g., SEQ ID NOs: 72-85), optionally without substantially reducing ear length (e.g., a decrease of less than 30%). In some embodiments, a LRR-RLK gene encodes a LRR-RLK polypeptide comprising an amino acid sequence having at least 70% identity (e.g., about 70, 71, 72, 73, 74, 75, 80, 81, 82, 83, 84, 85, 86, 87, 88, 89, 90, 91, 92, 93, 94, 95, 96, 97, 98, 99, 99.5, 100% sequence identity) to any one of the amino acid sequences of SEQ ID NOs: 86-100 or comprising a region having the amino acid sequence of any one of SEQ ID NOs: 118-179. In some embodiments, a LRR-RLK gene may comprise a sequence having at least about 70% sequence identity (e.g., about 70, 71, 72, 73, 74, 75, 80, 81, 82, 83, 84, 85, 86, 87, 88, 89, 90, 91, 92, 93, 94, 95, 96, 97, 98, 99, 99.5, 100% sequence identity) to the nucleotide sequence of any one of SEQ ID NOs: 72-85.

In some embodiments, the at least one non-naturally introduced mutation in an endogenous LRR-RLK gene in a corn plant may be a substitution, a deletion and/or an insertion. In some embodiments, the at least one non-naturally introduced mutation in an endogenous LRR-RLK gene in a corn plant may be a substitution, a deletion and/or an insertion that results in a null mutation, a dominant negative mutation, a semi-dominant mutation, hypomorphic mutation, or a weak loss-of-function mutation and a plant having the phenotype of increased kernel row number (e.g., wherein the plant comprising the mutation produces ears having increased kernel row number, optionally wherein the ears exhibiting increased kernel row number do not have substantially reduced ear length, e.g., do not exhibit a decrease in length of less than 30%) as compared to a control corn plant (e.g., isogenic plant) not comprising the edit/mutation. In some embodiments, the mutation may be a substitution, a deletion and/or an insertion of one or more amino acid residues (e.g., 1, 2, 3, 4, 5, 6, 7, 8, 9, 10 or more amino acids of the LRR-RLK polypeptide) or the mutation may be a substitution, a deletion and/or an insertion of at least 1 nucleotide to about 10 nucleotides. In some embodiments, the mutation may be a deletion or insertion of 1 nucleotide to about 160 consecutive nucleotides (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides, or any range or value therein) (e.g., a base deletion and/or insertion) from the gene encoding the LRR-RLK polypeptide. In some embodiments, a non-naturally introduced mutation may be a deletion. In some embodiments, the mutation may be a deletion of at least about 18 consecutive base pairs to about 160 consecutive base pairs (e.g., about 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 consecutive base pairs to about 60, 70, 80, 90, 100, 110, 120, 130, 131, 132, 133, 134, 135, 136, 137, 138, 139, 140, 145, 150, 155, or 160 consecutive base pairs or any value or range therein of a LRR-RLK gene. In some embodiments, a deletion results in an in-frame deletion allele. In some embodiments, the at least one mutation may be a base substitution to an A, a T, a G, or a C. In some embodiments, the at least one mutation may be a base substitution to from a C to a T (C>T) or a base substitution to from a G to an A (G>A). In some embodiments, the at least one mutation is in a region of a LRR-RLK polypeptide, the region having the sequence of any one of the amino acid sequences of SEQ ID NOs: 123-179, and/or the region comprising at least one of the motifs comprising (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO: 119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S.

In some embodiments, a mutation in an endogenous LRR-RLK gene may be made following cleavage by an editing system that comprises a nuclease and a DNA-binding domain that binds to a target site within a target nucleic acid (e.g., a LRR-RLK gene), the target nucleic acid (e.g., LRR-RLK gene) (a) comprising a sequence having at least 90% sequence identity to any one of the nucleotide sequences of SEQ ID NO:72-85; (b) encoding a sequence having at least 90% sequence identity to any one of the amino acid sequences of SEQ ID NOs: 86-100; (c) encoding a sequence having at least 90% sequence identity to a sequence comprising one or more motifs having: (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (d) encoding a sequence comprising a region having the sequence of any one of the amino acid sequences of SEQ ID NOs: 123-179. In some embodiments, the cleavage results in a mutation in an endogenous LRR-RLK gene encoding a sequence having at least 90% identity to any one of the sequences of SEQ ID NOs: 180-193.

Further provided herein are guide nucleic acids (e.g., gRNA, gDNA, crRNA, crDNA) that binds to a target site in a LRR-RLK gene, the target site (a) comprising a sequence having at least 90% sequence identity to any one of the amino acid sequences of SEQ ID NOs: 86-100; (b) having a sequence comprising one or more motifs having (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and $W^1$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (c) comprising a region having the sequence of any one of the amino acid sequences of SEQ ID NOs: 123-179.

In some embodiments, a system is provided comprising a guide nucleic acid comprising a spacer having the nucleotide sequence of any one of SEQ ID NOs: 101-117 or SEQ ID NOs: 243-266 and a CRISPR-Cas effector protein that associates with the guide nucleic acid. In some embodiments, the system may further comprise a tracr nucleic acid that associates with the guide nucleic acid and a CRISPR-Cas effector protein, optionally wherein the tracr nucleic acid and the guide nucleic acid are covalently linked.

As used herein, "a CRISPR-Cas effector protein in association with a guide nucleic acid" or "a CRISPR-Cas effector protein that associates with the guide nucleic acid" refers to the complex that is formed between a CRISPR-Cas effector protein and a guide nucleic acid in order to direct the CRISPR-Cas effector protein to a target site in a gene.

The invention further provides a gene editing system comprising a CRISPR-Cas effector protein in association with a guide nucleic acid and the guide nucleic acid comprises a spacer sequence that binds to a LRR-RLK gene, the LRR-RLK gene (a) comprising a sequence having at least 90% sequence identity to any one of the amino acid sequences of SEQ ID NOs: 86-100; (b) having a sequence comprising one or more motifs having (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO: 120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (c) comprising a region having the sequence of any one of the amino acid sequences of SEQ ID NOs: 123-179. In some embodiments, a spacer sequence of the guide nucleic acid may comprise the nucleotide sequence of any one of SEQ ID NOs: 101-117 or SEQ ID NOs: 243-266. In some embodiments, the gene editing system may further comprise a tracr nucleic acid that associates with the guide nucleic acid and a CRISPR-Cas effector protein, optionally wherein the tracr nucleic acid and the guide nucleic acid are covalently linked.

The present invention further provides a complex comprising a CRISPR-Cas effector protein comprising a cleavage domain and a guide nucleic acid, wherein the guide nucleic acid binds to a target site in an endogenous LRR-RLK gene, wherein the endogenous LRR-RIK gene, wherein the endogenous LRR-RLK gene: (a) comprises a sequence having at least 90% sequence identity to any one of the nucleotide sequences of SEQ ID NO:72-85; (b) encodes a sequence having at least 90% sequence identity to any one of the amino acid sequences of SEQ ID NOs: 86-100; (c) encodes a sequence having at least 90% sequence identity to a sequence comprising one or more motifs having: (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO:120) wherein $X_1$=K or R and $X_2$=L or F, (iv) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (d) encodes a sequence comprising a region having the sequence of any one of the amino acid sequences of SEQ ID NOs: 123-179, wherein the cleavage domain cleaves a target strand in the LRR-RLK gene. In some embodiments, the cleavage domain cleaves a target strand in the LRR-RLK gene such that it results in a mutation in an endogenous LRR-RIK gene comprising a sequence having at least 90% identity to any one of the sequences of SEQ ID NOs: 180-193.

In some embodiments, expression cassettes are provided that comprise (a) polynucleotide encoding CRISPR-Cas effector protein comprising a cleavage domain and (b) a guide nucleic acid that binds to a target site in an endogenous LRR-RLK gene, wherein the guide nucleic acid comprises a spacer sequence that is complementary to and binds to (i) a portion of a nucleic acid encoding an amino acid sequence having at least 90% sequence identity to any one of the amino acid sequences of SEQ ID NOs: 86-100; (ii) a portion of a sequence having at least 90% sequence identity to any one of the nucleotide sequences of SEQ ID NO:72-85; and/or (iii) a region having the sequence of any one of the amino acid sequences of SEQ ID NOs: 123-179.

Also provided herein are nucleic acids encoding a mutated LRR-RLK gene that when present in a corn plant or plant part results in the corn plant comprising a phenotype of increased kernel row number (optionally without substantially reducing ear length) as compared to a corn plant or plant part not comprising the LRR-RLK mutation (e.g., an isogenic corn plant not comprising the mutation). In some embodiments, a mutated LRR-RIK gene may encode a sequence having at least 90% sequence identity to any one of the amino acid sequences of SEQ ID NOs: 180-193.

Nucleic acid constructs of the invention (e.g., a construct comprising a sequence specific nucleic acid binding domain, a CRISPR-Cas effector domain, a deaminase domain, reverse transcriptase (RT), RT template and/or a guide nucleic acid, etc.) and expression cassettes/vectors comprising the same may be used as an editing system of this invention for modifying target nucleic acids (e.g., endogenous LRR-RLK genes) and/or their expression.

Any corn plant comprising an endogenous LRR-RLK gene that is capable of conferring increased kernel row number when modified as described herein may be modified (e.g., mutated, e.g., base edited, cleaved, nicked, etc.) as described herein (e.g., using the polypeptides, polynucleotides, RNPs, nucleic acid constructs, expression cassettes, and/or vectors of the invention) to increase kernel row number in the corn plant. A plant exhibiting increased kernel row number (e.g., a corn plant) may have an increase in kernel row number by about 5% to about 50% (e.g., about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50% or any range or value therein; e.g., about 5% to about 10%, about 5% to about 15%, about 5% to about 20%, about 10% to about 50%, about 20% to about 50%, about 30% to about 50%, and any range or value therein) (e.g., about 1, 2, 3, 4, 5, 6, 7, 8, 9, 10, 11, 12, 13, 14, or 15 more rows) as compared to a plant or part thereof that does not comprise the mutated endogenous LRR-RLK gene. In some embodiments, plants exhibiting increased kernel row number as described herein (e.g., a plant that produces ears having increased kernel row number) produce ears that are also not substantially decreased in length. As used herein, an ear of a plant comprising a mutation as described herein that is "not substantially decreased in length" has a length that is reduced by less than 30% (e.g., reduced by 0% or reduced by about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30%) as compared to a plant that does not comprise the same LRR-RLK mutation.

The term "plant part," as used herein, includes but is not limited to reproductive tissues (e.g., petals, sepals, stamens, pistils, receptacles, anthers, pollen, flowers, fruits, flower bud, ovules, seeds, and embryos); vegetative tissues (e.g., petioles, stems, roots, root hairs, root tips, pith, coleoptiles, stalks, shoots, branches, bark, apical meristem, axillary bud, cotyledon, hypocotyls, and leaves); vascular tissues (e.g., phloem and xylem); specialized cells such as epidermal cells, parenchyma cells, chollenchyma cells, schlerenchyma cells, stomates, guard cells, cuticle, mesophyll cells; callus tissue; and cuttings. The term "plant part" also includes plant cells, including plant cells that are intact in plants and/or parts of plants, plant protoplasts, plant tissues, plant organs, plant cell tissue cultures, plant calli, plant clumps, and the like. As used herein, "shoot" refers to the above ground parts including the leaves and stems. As used herein, the term "tissue culture" encompasses cultures of tissue, cells, protoplasts and callus.

As used herein, "plant cell" refers to a structural and physiological unit of the plant, which typically comprise a cell wall but also includes protoplasts. A plant cell of the present invention can be in the form of an isolated single cell or can be a cultured cell or can be a part of a higher-organized unit such as, for example, a plant tissue (including callus) or a plant organ. A "protoplast" is an isolated plant cell without a cell wall or with only parts of the cell wall. Thus, in some embodiments of the invention, a transgenic cell comprising a nucleic acid molecule and/or nucleotide sequence of the invention is a cell of any plant or plant part including, but not limited to, a root cell, a leaf cell, a tissue culture cell, a seed cell, a flower cell, a fruit cell, a pollen cell, and the like. In some aspects of the invention, the plant part can be a plant germplasm. In some aspects, a plant cell can be non-propagating plant cell that does not regenerate into a plant.

"Plant cell culture" means cultures of plant units such as, for example, protoplasts, cell culture cells, cells in plant tissues, pollen, pollen tubes, ovules, embryo sacs, zygotes and embryos at various stages of development.

As used herein, a "plant organ" is a distinct and visibly structured and differentiated part of a plant such as a root, stem, leaf, flower bud, or embryo.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural and/or functional units. The use of this term in conjunction with, or in the absence of, any specific type of plant tissue as listed above or otherwise embraced by this definition is not intended to be exclusive of any other type of plant tissue.

In some embodiments of the invention, a transgenic tissue culture or transgenic plant cell culture is provided, wherein the transgenic tissue or cell culture comprises a nucleic acid molecule/nucleotide sequence of the invention. In some embodiments, transgenes may be eliminated from a plant developed from the transgenic tissue or cell by breeding of the transgenic plant with a non-transgenic plant and selecting among the progeny for the plants comprising the desired gene edit and not the transgenes used in producing the edit.

An editing system useful with this invention can be any site-specific (sequence-specific) genome editing system now known or later developed, which system can introduce mutations in target specific manner. For example, an editing system (e.g., site-or sequence-specific editing system) can include, but is not limited to, a CRISPR-Cas editing system, a meganuclease editing system, a zinc finger nuclease (ZFN) editing system, a transcription activator-like effector nuclease (TALEN) editing system, a base editing system and/or a prime editing system, each of which can comprise one or more polypeptides and/or one or more polynucleotides that when expressed as a system in a cell can modify (mutate) a target nucleic acid in a sequence specific manner. In some embodiments, an editing system (e.g., site- or sequence-specific editing system) can comprise one or more polynucleotides and/or one or more polypeptides, including but not limited to a nucleic acid binding domain (DNA binding domain), a nuclease, and/or other polypeptide, and/or a polynucleotide.

In some embodiments, an editing system can comprise one or more sequence-specific nucleic acid binding domains (DNA binding domains) that can be from, for example, a polynucleotide-guided endonuclease, a CRISPR-Cas endonuclease (e.g., CRISPR-Cas effector protein), a zinc finger nuclease, a transcription activator-like effector nuclease (TALEN) and/or an Argonaute protein. In some embodiments, an editing system can comprise one or more cleavage domains (e.g., nucleases) including, but not limited to, an endonuclease (e.g., Fok1), a polynucleotide-guided endonuclease, a CRISPR-Cas endonuclease (e.g., CRISPR-Cas effector protein), a zinc finger nuclease, and/or a transcription activator-like effector nuclease (TALEN). In some embodiments, an editing system can comprise one or more polypeptides that include, but are not limited to, a deaminase (e.g., a cytosine deaminase, an adenine deaminase), a reverse transcriptase, a Dna2 polypeptide, and/or a 5' flap endonuclease (FEN). In some embodiments, an editing system can comprise one or more polynucleotides, including, but is not limited to, a CRISPR array (CRISPR guide) nucleic acid, extended guide nucleic acid, and/or a reverse transcriptase template.

In some embodiments, a method of modifying or editing an LRR-RLK gene may comprise contacting a target nucleic acid (e.g., a nucleic acid encoding an LRR-RLK protein) with a base-editing fusion protein (e.g., a sequence specific nucleic acid binding protein (e.g., a CRISPR-Cas effector protein or domain) fused to a deaminase domain (e.g., an adenine deaminase and/or a cytosine deaminase) and a guide nucleic acid, wherein the guide nucleic acid is capable of guiding/targeting the base editing fusion protein to the target nucleic acid, thereby editing a locus within the target nucleic acid. In some embodiments, a base editing fusion protein and guide nucleic acid may be comprised in one or more expression cassettes. In some embodiments, the target nucleic acid may be contacted with a base editing fusion protein and an expression cassette comprising a guide nucleic acid. In some embodiments, the sequence-specific nucleic acid binding fusion proteins and guides may be provided as ribonucleoproteins (RNPs). In some embodiments, a cell may be contacted with more than one base-editing fusion protein and/or one or more guide nucleic acids that may target one or more target nucleic acids in the cell.

In some embodiments, a method of modifying or editing an LRR-RLK gene may comprise contacting a target nucleic acid (e.g., a nucleic acid encoding a LRR-RLK) with a sequence-specific nucleic acid binding fusion protein (e.g., a sequence-specific nucleic acid binding protein (e.g., a CRISPR-Cas effector protein or domain) fused to a peptide tag, a deaminase fusion protein comprising a deaminase domain (e.g., an adenine deaminase and/or a cytosine deaminase) fused to an affinity polypeptide that is capable of binding to the peptide tag, and a guide nucleic acid, wherein the guide nucleic acid is capable of guiding/targeting the sequence-specific nucleic acid binding fusion protein to the target nucleic acid and the sequence-specific nucleic acid binding fusion protein is capable of recruiting the deaminase fusion protein to the target nucleic acid via the peptide tag-affinity polypeptide interaction, thereby editing a locus within the target nucleic acid. In some embodiments, the sequence-specific nucleic acid binding fusion protein may be fused to the affinity polypeptide that binds the peptide tag and the deaminase may be fuse to the peptide tag, thereby recruiting the deaminase to the sequence-specific nucleic acid binding fusion protein and to the target nucleic acid. In some embodiments, the sequence-specific binding fusion protein, deaminase fusion protein, and guide nucleic acid may be comprised in one or more expression cassettes. In some embodiments, the target nucleic acid may be contacted with a sequence-specific binding fusion protein, deaminase fusion protein, and an expression cassette comprising a guide nucleic acid. In some embodiments, the sequence-specific nucleic acid binding fusion proteins, deaminase fusion proteins and guides may be provided as ribonucleoproteins (RNPs).

In some embodiments, methods such as prime editing may be used to generate a mutation in an endogenous LRR-RLK gene. In prime editing, RNA-dependent DNA polymerase (reverse transcriptase, RT) and reverse transcriptase templates (RT template) are used in combination with sequence specific nucleic acid binding domains that confer the ability to recognize and bind the target in a sequence-specific manner, and which can also cause a nick of the PAM-containing strand within the target. The nucleic acid binding domain may be a CRISPR-Cas effector protein and in this case, the CRISPR array or guide RNA may be an extended guide that comprises an extended portion comprising a primer binding site (PSB) and the edit to be incorporated into the genome (the template). Similar to base editing, prime editing can take advantageous of the various methods of recruiting proteins for use in the editing to the target site, such methods including both non-covalent and covalent interactions between the proteins and nucleic acids used in the selected process of genome editing.

As used herein, a "CRISPR-Cas effector protein" is a protein or polypeptide or domain thereof that cleaves or cuts a nucleic acid, binds a nucleic acid (e.g., a target nucleic acid and/or a guide nucleic acid), and/or that identifies, recognizes, or binds a guide nucleic acid as defined herein. In some embodiments, a CRISPR-Cas effector protein may be an enzyme (e.g., a nuclease, endonuclease, nickase, etc.) or portion thereof and/or may function as an enzyme. In some embodiments, a CRISPR-Cas effector protein refers to a CRISPR-Cas nuclease polypeptide or domain thereof that comprises nuclease activity or in which the nuclease activity has been reduced or eliminated, and/or comprises nickase activity or in which the nickase has been reduced or eliminated, and/or comprises single stranded DNA cleavage activity (ss DNAse activity) or in which the ss DNAse activity has been reduced or eliminated, and/or comprises self-processing RNAse activity or in which the self-processing RNAse activity has been reduced or eliminated. A CRISPR-Cas effector protein may bind to a target nucleic acid.

In some embodiments, a sequence-specific nucleic acid binding domain may be a CRISPR-Cas effector protein. In some embodiments, a CRISPR-Cas effector protein may be from a Type I CRISPR-Cas system, a Type II CRISPR-Cas system, a Type III CRISPR-Cas system, a Type IV CRISPR-Cas system, Type V CRISPR-Cas system, or a Type VI CRISPR-Cas system. In some embodiments, a CRISPR-Cas effector protein of the invention may be from a Type II CRISPR-Cas system or a Type V CRISPR-Cas system. In some embodiments, a CRISPR-Cas effector protein may be Type II CRISPR-Cas effector protein, for example, a Cas9 effector protein. In some embodiments, a CRISPR-Cas effector protein may be Type V CRISPR-Cas effector protein, for example, a Cas12 effector protein.

In some embodiments, a CRISPR-Cas effector protein may include, but is not limited to, a Cas9, C2c1, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5 nuclease, optionally wherein the CRISPR-Cas effector protein may be a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or Cas14c effector protein.

In some embodiments, a CRISPR-Cas effector protein useful with the invention may comprise a mutation in its nuclease active site (e.g., RuvC, HNH, e.g., RuvC site of a Cas12a nuclease domain; e.g., RuvC site and/or HNH site of a Cas9 nuclease domain). A CRISPR-Cas effector protein having a mutation in its nuclease active site, and therefore, no longer comprising nuclease activity, is commonly referred to as "dead," e.g., dCas. In some embodiments, a CRISPR-Cas effector protein domain or polypeptide having a mutation in its nuclease active site may have impaired activity or reduced activity as compared to the same CRISPR-Cas effector protein without the mutation, e.g., a nickase, e.g, Cas9 nickase, Cas12a nickase.

A CRISPR Cas9 effector protein or CRISPR Cas9 effector domain useful with this invention may be any known or later identified Cas9 nuclease. In some embodiments, a CRISPR Cas9 polypeptide can be a Cas9 polypeptide from, for example, *Streptococcus* spp. (e.g., *S. pyogenes, S. thermophilus*), *Lactobacillus* spp., *Bifidobacterium* spp., Kandleria spp., *Leuconostoc* spp., Oenococcus spp., *Pediococcus* spp., Weissella spp., and/or Olsenella spp. Example Cas9 sequences include, but are not limited to, the amino acid sequences of SEQ ID NO: 53 and SEQ ID NO:54 or the nucleotide sequences of SEQ ID NOs: 55-65.

In some embodiments, the CRISPR-Cas effector protein may be a Cas9 polypeptide derived from *Streptococcus pyogenes* and recognizes the PAM sequence motif NGG, NAG, NGA (*Mali* et al, Science 2013; 339 (6121): 823-826). In some embodiments, the CRISPR-Cas effector protein may be a Cas9 polypeptide derived from *Streptococcus* thermophiles and recognizes the PAM sequence motif NGGNG and/or NNAGAAW (W=A or T) (See, e.g., Horvath et al, Science, 2010; 327 (5962): 167-170, and Deveau et al, J Bacteriol 2008; 190 (4): 1390-1400). In some embodiments, the CRISPR-Cas effector protein may be a Cas9 polypeptide derived from *Streptococcus mutans* and recognizes the PAM sequence motif NGG and/or NAAR (R=A or G) (See, e.g., Deveau et al, J BACTERIOL 2008; 190 (4): 1390-1400). In some embodiments, the CRISPR-Cas effector protein may be a Cas9 polypeptide derived from *Streptococcus aureus* and recognizes the PAM sequence motif NNGRR (R=A or G). In some embodiments, the CRISPR-Cas effector protein may be a Cas9 protein derived from *S. aureus*, which recognizes the PAM sequence motif N GRRT (R=A or G). In some embodiments, the CRISPR-Cas effector protein may be a Cas9 polypeptide derived from *S. aureus*, which recognizes the PAM sequence motif N GRRV (R=A or G). In some embodiments, the CRISPR-Cas effector protein may be a Cas9 polypeptide that is derived from *Neisseria meningitidis* and recognizes the PAM sequence motif N GATT or N GCTT (R=A or G, V=A, G or C) (See, e.g., Hou et ah, PNAS 2013, 1-6). In the aforementioned embodiments, N can be any nucleotide residue, e.g., any of A, G, C or T. In some embodiments, the CRISPR-Cas effector protein may be a Cas13a protein derived from Leptotrichia shahii, which recognizes a protospacer flanking sequence (PFS) (or RNA PAM (rPAM)) sequence motif of a single 3' A, U, or C, which may be located within the target nucleic acid.

In some embodiments, the CRISPR-Cas effector protein may be derived from Cas12a, which is a Type V Clustered Regularly Interspaced Short Palindromic Repeats (CRISPR)-Cas nuclease see, e.g., SEQ ID NOs: 1-20).

Cas12a differs in several respects from the more well-known Type II CRISPR Cas9 nuclease. For example, Cas9 recognizes a G-rich protospacer-adjacent motif (PAM) that is 3' to its guide RNA (gRNA, sgRNA, crRNA, crDNA, CRISPR array) binding site (protospacer, target nucleic acid, target DNA) (3'-NGG), while Cas12a recognizes a T-rich PAM that is located 5' to the target nucleic acid (5'-TTN, 5'-TTTN. In fact, the orientations in which Cas9 and Cas12a bind their guide RNAs are very nearly reversed in relation to their N and C termini. Furthermore, Cas12a enzymes use a single guide RNA (gRNA, CRISPR array, crRNA) rather than the dual guide RNA (sgRNA (e.g., crRNA and tracrRNA)) found in natural Cas9 systems, and Cas 12a processes its own gRNAs. Additionally, Cas 12a nuclease activity produces staggered DNA double stranded breaks instead of blunt ends produced by Cas9 nuclease activity, and Cas12a relies on a single RuvC domain to cleave both DNA strands, whereas Cas9 utilizes an HNH domain and a RuvC domain for cleavage.

A CRISPR Cas12a effector protein/domain useful with this invention may be any known or later identified Cas 12a polypeptide (previously known as Cpf1) (see, e.g., U.S. U.S. Pat. No. 9,790,490, which is incorporated by reference for its disclosures of Cpf1 (Cas12a) sequences). The term "Cas12a", "Cas12a polypeptide" or "Cas12a domain" refers to an RNA-guided nuclease comprising a Cas12a polypeptide, or a fragment thereof, which comprises the guide nucleic acid binding domain of Cas12a and/or an active, inactive, or partially active DNA cleavage domain of Cas12a. In some embodiments, a Cas12a useful with the invention may comprise a mutation in the nuclease active site (e.g., RuvC site of the Cas12a domain). A Cas12a domain or Cas12a polypeptide having a mutation in its nuclease active site, and therefore, no longer comprising nuclease activity, is commonly referred to as deadCas12a (e.g., dCas12a). In some embodiments, a Cas12a domain or Cas12a polypeptide having a mutation in its nuclease active site may have impaired activity, e.g., may have nickase activity.

Any deaminase domain/polypeptide useful for base editing may be used with this invention. In some embodiments, the deaminase domain may be a cytosine deaminase domain or an adenine deaminase domain. A cytosine deaminase (or cytidine deaminase) useful with this invention may be any known or later identified cytosine deaminase from any organism (see, e.g., U.S. Pat. No. 10,167,457 and Thuronyi et al. *Nat. Biotechnol.* 37:1070-1079 (2019), each of which is incorporated by reference herein for its disclosure of cytosine deaminases). Cytosine deaminases can catalyze the hydrolytic deamination of cytidine or deoxycytidine to uridine or deoxyuridine, respectively. Thus, in some embodiments, a deaminase or deaminase domain useful with this invention may be a cytidine deaminase domain, catalyzing the hydrolytic deamination of cytosine to uracil. In some embodiments, a cytosine deaminase may be a variant of a naturally occurring cytosine deaminase, including but not limited to a primate (e.g., a human, monkey, chimpanzee, gorilla), a dog, a cow, a rat or a mouse. Thus, in some embodiments, a cytosine deaminase useful with the invention may be about 70% to about 100% identical to a wild type cytosine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring cytosine deaminase).

In some embodiments, a cytosine deaminase useful with the invention may be an apolipoprotein B mRNA-editing complex (APOBEC) family deaminase. In some embodiments, the cytosine deaminase may be an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, an APOBEC4 deaminase, a human activation induced deaminase (hAID), an rAPOBEC1, FERNY, and/or a CDA1, optionally a pmCDA1, an atCDA1 (e.g., At2g19570), and evolved versions of the same (e.g., SEQ ID NO:27, SEQ ID NO: 28 or SEQ ID NO:29). In some embodiments, the cytosine deaminase may be an APOBEC1 deaminase having the amino acid sequence of SEQ ID NO:23. In some embodiments, the cytosine deaminase may be an APOBEC3A deaminase having the amino acid sequence of SEQ ID NO:24. In some embodiments, the cytosine deaminase may be an CDA1 deaminase, optionally a CDA1 having the amino acid sequence of SEQ ID NO:25. In some embodiments, the cytosine deaminase may be a FERNY deaminase, optionally a FERNY having the amino acid sequence of SEQ ID NO:26. In some embodiments, a cytosine deaminase useful with the invention may be about 70% to about 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical) to the amino acid sequence of a naturally occurring cytosine deaminase (e.g., an evolved deaminase). In some embodiments, a cytosine deaminase useful with the invention may be about 70% to about 99.5% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 99.5% identical) to the amino acid sequence of SEQ ID NO:23, SEQ ID NO:24, SEQ ID NO:25 or SEQ ID NO:26 (e.g., at least 80%, at least 85%, at least 90%, at least 92%, at least 95%, at least 96%, at least 97%, at least 98%, at least 99%, or at least 99.5% identical to the amino acid sequence of SEQ ID NO: 23, SEQ ID NO:24, SEQ ID NO:25, SEQ ID NO:26, SEQ ID NO:27, SEQ ID NO:28 or SEQ ID NO:29). In some embodiments, a polynucleotide encoding a cytosine deaminase may be codon optimized for expression in a plant and the codon optimized polypeptide may be about 70% to 99.5% identical to the reference polynucleotide.

In some embodiments, a nucleic acid construct of this invention may further encode a uracil glycosylase inhibitor (UGI) (e.g., uracil-DNA glycosylase inhibitor) polypeptide/domain. Thus, in some embodiments, a nucleic acid construct encoding a CRISPR-Cas effector protein and a cytosine deaminase domain (e.g., encoding a fusion protein comprising a CRISPR-Cas effector protein domain fused to a cytosine deaminase domain, and/or a CRISPR-Cas effector protein domain fused to a peptide tag or to an affinity polypeptide capable of binding a peptide tag and/or a deaminase protein domain fused to a peptide tag or to an affinity polypeptide capable of binding a peptide tag) may further encode a uracil-DNA glycosylase inhibitor (UGI), optionally wherein the UGI may be codon optimized for expression in a plant. In some embodiments, the invention provides fusion proteins comprising a CRISPR-Cas effector polypeptide, a deaminase domain, and a UGI and/or one or more polynucleotides encoding the same, optionally wherein the one or more polynucleotides may be codon optimized for expression in a plant. In some embodiments, the invention provides fusion proteins, wherein a CRISPR-Cas effector polypeptide, a deaminase domain, and a UGI may be fused to any combination of peptide tags and affinity polypeptides as described herein, thereby recruiting the deaminase domain and UGI to the CRISPR-Cas effector polypeptide and a target nucleic acid. In some embodiments, a guide nucleic acid may be linked to a recruiting RNA motif and one or more of the deaminase domain and/or UGI may be fused to an affinity polypeptide that is capable of interacting with the recruiting RNA motif, thereby recruiting the deaminase domain and UGI to a target nucleic acid.

A "uracil glycosylase inhibitor" useful with the invention may be any protein that is capable of inhibiting a uracil-DNA glycosylase base-excision repair enzyme. In some embodiments, a UGI domain comprises a wild type UGI or a fragment thereof. In some embodiments, a UGI domain useful with the invention may be about 70% to about 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical and any range or value therein) to the amino acid sequence of a naturally occurring UGI domain. In some embodiments, a UGI domain may comprise the amino acid sequence of SEQ ID NO:41 or a polypeptide having about 70% to about 99.5% sequence identity to the amino acid sequence of SEQ ID NO:41 (e.g., at least 80%, at least 85%, at least 90%, at least 92%, at least 95%, at least 96%, at least 97%, at least 98%, at least 99%, or at least 99.5% identical to the amino acid sequence of SEQ ID NO:41). For example, in some embodiments, a UGI domain may comprise a fragment of the amino acid sequence of SEQ ID NO:41 that is 100% identical to a portion of consecutive nucleotides (e.g., 10, 15, 20, 25, 30, 35, 40, 45, 50, 55, 60, 65, 70, 75, 80 consecutive nucleotides; e.g., about 10, 15, 20, 25, 30, 35, 40, 45, to about 50, 55, 60, 65, 70, 75, 80 consecutive nucleotides) of the amino acid sequence of SEQ ID NO:41. In some embodiments, a UGI domain may be a variant of a known UGI (e.g., SEQ ID NO:41) having about 70% to about 99.5% sequence identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% sequence identity, and any range or value therein) to the known UGI. In some embodiments, a polynucleotide encoding a UGI may be codon optimized for expression in a plant (e.g., a plant) and the codon optimized polypeptide may be about 70% to about 99.5% identical to the reference polynucleotide.

An adenine deaminase (or adenosine deaminase) useful with this invention may be any known or later identified adenine deaminase from any organism (see, e.g., U.S. Pat. No. 10,113,163, which is incorporated by reference herein for its disclosure of adenine deaminases). An adenine deaminase can catalyze the hydrolytic deamination of adenine or adenosine. In some embodiments, the adenine deaminase may catalyze the hydrolytic deamination of adenosine or deoxyadenosine to inosine or deoxyinosine, respectively. In some embodiments, the adenosine deaminase may catalyze the hydrolytic deamination of adenine or adenosine in DNA. In some embodiments, an adenine deaminase encoded by a nucleic acid construct of the invention may generate an A->G conversion in the sense (e.g., "+"; template) strand of the target nucleic acid or a T->C conversion in the antisense (e.g., "−", complementary) strand of the target nucleic acid.

In some embodiments, an adenosine deaminase may be a variant of a naturally occurring adenine deaminase. Thus, in some embodiments, an adenosine deaminase may be about 70% to 100% identical to a wild type adenine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring adenine deaminase). In some embodiments, the deaminase or deaminase does not occur in nature and may be referred to as an engineered, mutated or evolved adenosine deaminase. Thus, for example, an engineered, mutated or evolved adenine deaminase polypeptide or an adenine deaminase domain may be about 70% to 99.9% identical to a naturally occurring adenine deaminase polypeptide/domain (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% identical, and any range or value therein, to a naturally occurring adenine deaminase polypeptide or adenine deaminase domain). In some embodiments, the adenosine deaminase may be from a bacterium, (e.g., *Escherichia coli, Staphylococcus aureus, Haemophilus influenzae*, (*'aulobacter crescentus*, and the like). In some embodiments, a polynucleotide encoding an adenine deaminase polypeptide/domain may be codon optimized for expression in a plant.

In some embodiments, an adenine deaminase domain may be a wild type tRNA-specific adenosine deaminase domain, e.g., a tRNA-specific adenosine deaminase (TadA) and/or a mutated/evolved adenosine deaminase domain, e.g., mutated/evolved tRNA-specific adenosine deaminase domain (TadA*). In some embodiments, a TadA domain may be from *E. coli*. In some embodiments, the TadA may be modified, e.g., truncated, missing one or more N-terminal and/or C-terminal amino acids relative to a full-length TadA (e.g., 1, 2, 3, 4, 5, 6, 7, 8, 9, 10, 11, 12, 13, 14, 15, 6, 17, 18, 19, or 20 N-terminal and/or C terminal amino acid residues may be missing relative to a full length TadA. In some embodiments, a TadA polypeptide or TadA domain does not comprise an N-terminal methionine. In some embodiments, a wild type *E. coli* TadA comprises the amino acid sequence of SEQ ID NO: 30. In some embodiments, a mutated/evolved *E. coli* TadA* comprises the amino acid sequence of SEQ ID NOs: 31-40 (e.g., SEQ ID NOs: 31, 32, 33, 34, 35, 36, 37, 38, 39 or 40). In some embodiments, a polynucleotide encoding a TadA/TadA* may be codon optimized for expression in a plant.

A cytosine deaminase catalyzes cytosine deamination and results in a thymidine (through a uracil intermediate), causing a C to T conversion, or a G to A conversion in the complementary strand in the genome. Thus, in some embodiments, the cytosine deaminase encoded by the polynucleotide of the invention generates a C→T conversion in the sense (e.g., "+"; template) strand of the target nucleic acid or a G→A conversion in antisense (e.g., "−", complementary) strand of the target nucleic acid.

In some embodiments, the adenine deaminase encoded by the nucleic acid construct of the invention generates an A→G conversion in the sense (e.g., "+"; template) strand of the target nucleic acid or a T→C conversion in the antisense (e.g., "−", complementary) strand of the target nucleic acid.

The nucleic acid constructs of the invention encoding a base editor comprising a sequence-specific nucleic acid binding protein and a cytosine deaminase polypeptide, and nucleic acid constructs/expression cassettes/vectors encoding the same, may be used in combination with guide nucleic acids for modifying target nucleic acid including, but not limited to, generation of C→T or G→A mutations in a target nucleic acid including, but not limited to, a plasmid sequence; generation of C→T or G→A mutations in a coding sequence to alter an amino acid identity; generation of C→T or G→A mutations in a coding sequence to generate a stop codon; generation of C→T or G→A mutations in a coding sequence to disrupt a start codon; generation of point mutations in genomic DNA to disrupt function; and/or generation of point mutations in genomic DNA to disrupt splice junctions.

The nucleic acid constructs of the invention encoding a base editor comprising a sequence-specific nucleic acid binding protein and an adenine deaminase polypeptide, and expression cassettes and/or vectors encoding the same may be used in combination with guide nucleic acids for modifying a target nucleic acid including, but not limited to, generation of A→G or T→C mutations in a target nucleic acid including, but not limited to, a plasmid sequence; generation of A→G or T→C mutations in a coding sequence to alter an amino acid identity; generation of A→G or T→C mutations in a coding sequence to generate a stop codon; generation of A→G or T→C mutations in a coding sequence to disrupt a start codon; generation of point mutations in genomic DNA to disrupt function; and/or generation of point mutations in genomic DNA to disrupt splice junctions.

The nucleic acid constructs of the invention comprising a CRISPR-Cas effector protein or a fusion protein thereof may be used in combination with a guide RNA (gRNA, CRISPR array, CRISPR RNA, crRNA), designed to function with the encoded CRISPR-Cas effector protein or domain, to modify a target nucleic acid. A guide nucleic acid useful with this invention comprises at least one spacer sequence and at least one repeat sequence. The guide nucleic acid is capable of forming a complex with the CRISPR-Cas nuclease domain encoded and expressed by a nucleic acid construct of the invention and the spacer sequence is capable of hybridizing to a target nucleic acid, thereby guiding the complex (e.g., a CRISPR-Cas effector fusion protein (e.g., CRISPR-Cas effector domain fused to a deaminase domain and/or a CRISPR-Cas effector domain fused to a peptide tag or an affinity polypeptide to recruit a deaminase domain and optionally, a UGI) to the target nucleic acid, wherein the target nucleic acid may be modified (e.g., cleaved or edited) or modulated (e.g., modulating transcription) by the deaminase domain.

As an example, a nucleic acid construct encoding a Cas9 domain linked to a cytosine deaminase domain (e.g., fusion protein) may be used in combination with a Cas9 guide nucleic acid to modify a target nucleic acid, wherein the cytosine deaminase domain of the fusion protein deaminates a cytosine base in the target nucleic acid, thereby editing the target nucleic acid. In a further example, a nucleic acid construct encoding a Cas9 domain linked to an adenine deaminase domain (e.g., fusion protein) may be used in combination with a Cas9 guide nucleic acid to modify a target nucleic acid, wherein the adenine deaminase domain of the fusion protein deaminates an adenosine base in the target nucleic acid, thereby editing the target nucleic acid.

Likewise, a nucleic acid construct encoding a Cas12a domain (or other selected CRISPR-Cas nuclease, e.g., C2c1, C2c3, Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5) linked to a cytosine deaminase domain or adenine deaminase domain (e.g., fusion protein) may be used in combination with a Cas12a guide nucleic acid (or the guide nucleic acid for the other selected CRISPR-Cas nuclease) to modify a target nucleic acid, wherein the cytosine deaminase domain or adenine deaminase domain of the fusion protein deaminates a cytosine base in the target nucleic acid, thereby editing the target nucleic acid.

A "guide nucleic acid," "guide RNA," "gRNA," "CRISPR RNA/DNA" "crRNA" or "crDNA" as used herein means a nucleic acid that comprises at least one spacer sequence, which is complementary to (and hybridizes to) a target DNA (e.g., protospacer), and at least one repeat sequence (e.g., a repeat of a Type V Cas12a CRISPR-Cas system, or a fragment or portion thereof; a repeat of a Type II Cas9 CRISPR-Cas system, or fragment thereof; a repeat of a Type V C2c1 CRISPR Cas system, or a fragment thereof; a repeat of a CRISPR-Cas system of, for example, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3'', Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5, or a fragment thereof), wherein the repeat sequence may be linked to the 5' end and/or the 3' end of the spacer sequence. The design of a gRNA of this invention may be based on a Type I, Type II, Type III, Type IV, Type V, or Type VI CRISPR-Cas system.

In some embodiments, a Cas12a gRNA may comprise, from 5' to 3', a repeat sequence (full length or portion thereof ("handle"); e.g., pseudoknot-like structure) and a spacer sequence.

In some embodiments, a guide nucleic acid may comprise more than one repeat sequence-spacer sequence (e.g., 2, 3, 4, 5, 6, 7, 8, 9, 10, or more repeat-spacer sequences) (e.g., repeat-spacer-repeat, e.g., repeat-spacer-repeat-spacer-repeat-spacer-repeat-spacer-repeat-spacer, and the like). The guide nucleic acids of this invention are synthetic, human-made and not found in nature. A gRNA can be quite long and may be used as an aptamer (like in the MS2 recruitment strategy) or other RNA structures hanging off the spacer.

A "repeat sequence" as used herein, refers to, for example, any repeat sequence of a wild-type CRISPR Cas locus (e.g., a Cas9 locus, a Cas12a locus, a C2c1 locus, etc.) or a repeat sequence of a synthetic crRNA that is functional with the CRISPR-Cas effector protein encoded by the nucleic acid constructs of the invention. A repeat sequence useful with this invention can be any known or later identified repeat sequence of a CRISPR-Cas locus (e.g., Type I, Type II, Type III, Type IV, Type V or Type VI) or it can be a synthetic repeat designed to function in a Type I, II, III, IV, V or VI CRISPR-Cas system. A repeat sequence may comprise a hairpin structure and/or a stem loop structure. In some embodiments, a repeat sequence may form a pseudoknot-like structure at its 5' end (i.e., "handle"). Thus, in some embodiments, a repeat sequence can be identical to or substantially identical to a repeat sequence from wild-type Type I CRISPR-Cas loci, Type II, CRISPR-Cas loci, Type III, CRISPR-Cas loci, Type IV CRISPR-Cas loci, Type V CRISPR-Cas loci and/or Type VI CRISPR-Cas loci. A repeat sequence from a wild-type CRISPR-Cas locus may be determined through established algorithms, such as using the CRISPRfinder offered through CRISPRdb (see, Grissa et al. *Nucleic Acids Res.* 35 (Web Server issue): W52-7). In some embodiments, a repeat sequence or portion thereof is linked at its 3' end to the 5' end of a spacer sequence, thereby forming a repeat-spacer sequence (e.g., guide nucleic acid, guide RNA/DNA, crRNA, crDNA).

In some embodiments, a repeat sequence comprises, consists essentially of, or consists of at least 10 nucleotides depending on the particular repeat and whether the guide nucleic acid comprising the repeat is processed or unprocessed (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 to 100 or more nucleotides, or any range or value therein). In some embodiments, a repeat sequence comprises, consists essentially of, or consists of about 10 to about 20, about 10 to about 30, about 10 to about 45, about 10 to about 50, about 15 to about 30, about 15 to about 40, about 15 to about 45, about 15 to about 50, about 20 to about 30, about 20 to about 40, about 20 to about 50, about 30 to about 40, about 40 to about 80, about 50 to about 100 or more nucleotides.

A repeat sequence linked to the 5' end of a spacer sequence can comprise a portion of a repeat sequence (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more contiguous nucleotides of a wild type repeat sequence). In some embodiments, a portion of a repeat sequence linked to the 5' end of a spacer sequence can be about five to about ten consecutive nucleotides in length (e.g., about 5, 6, 7, 8, 9, 10 nucleotides) and have at least 90% sequence identity (e.g., at least about 90%, 91%, 92%, 93%, 94%, 95%, 96%, 97%, 98%, 99%, or more (e.g., 99.1, 99.2, 99.3, 99.4, 99.5, 99.6, 99.7, 99.8, 99.9, or 100%)) to the same region (e.g., 5' end) of a wild type CRISPR Cas repeat nucleotide sequence. In some embodiments, a portion of a repeat sequence may comprise a pseudoknot-like structure at its 5' end (e.g., "handle").

A "spacer sequence" as used herein is a nucleotide sequence that is complementary to a target nucleic acid (e.g., target DNA) (e.g, protospacer) (e.g., consecutive nucleotides (a) within a sequence having at least 90% sequence identity to any one of the amino acid sequences of SEQ ID NOs: 86-100; (b) having a sequence comprising one or more motifs having (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V, (iii) the sequence of $DFGLAX_1X_2L$ (SEQ ID NO: 120) wherein $X_1$=K or R and $X_2$=L or F, (iv) the sequence of $DVX_1X_2X_3GX_4X_5LX_6EL$ (SEQ ID NO: 122), wherein $X_1$=F or Y, $X_2$=G or S, $X_3$=F, Y or I, $X_4$=I or V, $X_5$=L or V, and $X_6$=L, V or M, and/or (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or (c) comprising a region having the sequence of any one of the amino acid sequences of SEQ ID NOs: 123-179)). In some embodiments, a spacer sequence may include, but is not limited to, the nucleotide sequences of any one of SEQ ID NOs: 101-117 or SEQ ID NOs: 243-266. The spacer sequence can be fully complementary or substantially complementary (e.g., at least about 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more (e.g., 99.1, 99.2, 99.3, 99.4, 99.5, 99.6, 99.7, 99.8, 99.9, or 100%)) to a target nucleic acid. Thus, in some embodiments, the spacer sequence can have one, two, three, four, or five mismatches as compared to the target nucleic acid, which mismatches can be contiguous or non-contiguous. In some embodiments, the spacer sequence can have 70% complementarity to a target nucleic acid. In other embodiments, the spacer nucleotide sequence can have 80% complementarity to a target nucleic acid. In still other embodiments, the spacer nucleotide sequence can have 85%, 90%, 95%, 96%, 97%, 98%, 99% or 99.5% complementarity, and the like, to the target nucleic acid (protospacer). In some embodiments, the spacer sequence is 100% complementary to the target nucleic acid. A spacer sequence may have a length from about 15 nucleotides to about 30 nucleotides (e.g., 15, 16, 17, 18, 19, 20, 21, 22, 23, 24, 25, 26, 27, 28, 29, or 30 nucleotides, or any range or value therein). Thus, in some embodiments, a spacer sequence may have complete complementarity or substantial complementarity over a region of a target nucleic acid (e.g., protospacer) that is at least about 15 nucleotides to about 30 nucleotides in length. In some embodiments, the spacer is about 20 nucleotides in length. In some embodiments, the spacer is about 21, 22, or 23 nucleotides in length.

In some embodiments, the 5' region of a spacer sequence of a guide nucleic acid may be fully complementary to a target DNA, while the 3' region of the spacer may be substantially complementary to the target DNA (such as for a spacer in a Type V CRISPR-Cas system), or the 3' region of a spacer sequence of a guide nucleic acid may be identical to a target DNA, while the 5' region of the spacer may be substantially complementary to the target DNA (such as for a spacer in a Type II CRISPR-Cas system), and therefore, the overall complementarity of the spacer sequence to the target DNA may be less than 100%. Thus, for example, in a guide for a Type V CRISPR-Cas system, the first 1, 2, 3, 4, 5, 6, 7, 8, 9, 10 nucleotides in the 5' region (i.e., seed region) of, for example, a 20 nucleotide spacer sequence may be 100% complementary to the target DNA, while the remaining nucleotides in the 3' region of the spacer sequence are substantially complementary (e.g., at least about 70% complementary) to the target DNA. In some embodiments, the first 1 to 8 nucleotides (e.g., the first 1, 2, 3, 4, 5, 6, 7, 8, nucleotides, and any range therein) of the 5' end of the spacer sequence may be 100% complementary to the target DNA, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to the target DNA.

As a further example, in a guide for a Type II CRISPR-Cas system, the first 1, 2, 3, 4, 5, 6, 7, 8, 9, 10 nucleotides in the 3' region (i.e., seed region) of, for example, a 20 nucleotide spacer sequence may be 100% complementary to the target DNA, while the remaining nucleotides in the 5' region of the spacer sequence are substantially complementary (e.g., at least about 70% complementary) to the target DNA. In some embodiments, the first 1 to 10 nucleotides (e.g., the first 1, 2, 3, 4, 5, 6, 7, 8, 9, 10 nucleotides, and any range therein) of the 3' end of the spacer sequence may be 100% complementary to the target DNA, while the remaining nucleotides in the 5' region of the spacer sequence are substantially complementary (e.g., at least about 50% complementary (e.g., at least about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or any range or value therein)) to the target DNA.

In some embodiments, a seed region of a spacer may be about 8 to about 10 nucleotides in length, about 5 to about 6 nucleotides in length, or about 6 nucleotides in length.

As used herein, a "target nucleic acid", "target DNA," "target nucleotide sequence," "target region," or a "target region in the genome" refers to a region of a plant's genome that is fully complementary (100% complementary) or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a spacer sequence in a guide nucleic acid of this invention. A target region useful for a CRISPR-Cas system may be located immediately 3' (e.g., Type V CRISPR-Cas system) or immediately 5' (e.g., Type II CRISPR-Cas system) to a PAM sequence in the genome of the organism (e.g., a plant genome). A target region may be selected from any region of at least 15 consecutive nucleotides (e.g., 16, 17, 18, 19, 20, 21, 22, 23, 24, 25, 26, 27, 28, 29, 30 nucleotides, and the like) located immediately adjacent to a PAM sequence.

A "protospacer sequence" refers to the target double stranded DNA and specifically to the portion of the target DNA (e.g., or target region in the genome) that is fully or substantially complementary (and hybridizes) to the spacer sequence of the CRISPR repeat-spacer sequences (e.g., guide nucleic acids, CRISPR arrays, crRNAs).

In the case of Type V CRISPR-Cas (e.g., Cas12a) systems and Type II CRISPR-Cas (Cas9) systems, the protospacer sequence is flanked by (e.g., immediately adjacent to) a protospacer adjacent motif (PAM). For Type IV CRISPR-Cas systems, the PAM is located at the 5' end on the non-target strand and at the 3' end of the target strand (see below, as an example).

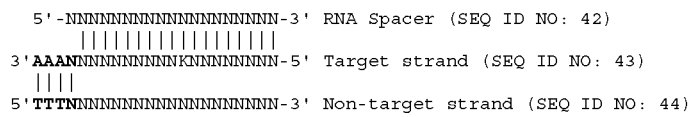

spacer sequence may be 100% complementary to the target DNA, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to the target DNA.

As a further example, in a guide for a Type II CRISPR-Cas system, the first 1, 2, 3, 4, 5, 6, 7, 8, 9, 10 nucleotides in the 3' region (i.e., seed region) of, for example, a 20 nucleotide spacer sequence may be 100% complementary to the target DNA, while the remaining nucleotides in the 5' region of the spacer sequence are substantially complementary (e.g., at least about 70% complementary) to the target DNA. In some embodiments, the first 1 to 10 nucleotides (e.g., the first 1, 2, 3, 4, 5, 6, 7, 8, 9, 10 nucleotides, and any range therein) of the 3' end of the spacer sequence may be 100% complementary to the target DNA, while the remaining nucleotides in the 5' region of the spacer sequence are substantially complementary (e.g., at least about 50%

In the case of Type II CRISPR-Cas (e.g., Cas9) systems, the PAM is located immediately 3' of the target region. The PAM for Type I CRISPR-Cas systems is located 5' of the target strand. There is no known PAM for Type III CRISPR-Cas systems. Makarova et al. describes the nomenclature for all the classes, types and subtypes of CRISPR systems (*Nature Reviews Microbiology* 13:722-736 (2015)). Guide structures and PAMs are described in by R. Barrangou (*Genome Biol.* 16:247 (2015)).

Canonical Cas12a PAMs are T rich. In some embodiments, a canonical Cas12a PAM sequence may be 5'-TTN, 5'-TTTN, or 5'-TTTV. In some embodiments, canonical Cas9 (e.g., *S. pyogenes*) PAMs may be 5'-NGG-3'. In some embodiments, non-canonical PAMs may be used but may be less efficient.

Additional PAM sequences may be determined by those skilled in the art through established experimental and computational approaches. Thus, for example, experimental approaches include targeting a sequence flanked by all possible nucleotide sequences and identifying sequence members that do not undergo targeting, such as through the transformation of target plasmid DNA (Esvelt et al. 2013. *Nat. Methods* 10:1116-1121; Jiang et al. 2013. *Nat. Biotechnol.* 31:233-239). In some aspects, a computational approach can include performing BLAST searches of natural spacers to identify the original target DNA sequences in bacteriophages or plasmids and aligning these sequences to determine conserved sequences adjacent to the target sequence (Briner and Barrangou. 2014. *Appl. Environ. Microbiol.* 80:994-1001; Mojica et al. 2009. *Microbiology* 155:733-740).

In some embodiments, the present invention provides expression cassettes and/or vectors comprising the nucleic acid constructs of the invention (e.g, one or more components of an editing system of the invention). In some embodiments, expression cassettes and/or vectors comprising the nucleic acid constructs of the invention and/or one or more guide nucleic acids may be provided. In some embodiments, a nucleic acid construct of the invention encoding a base editor (e.g., a construct comprising a CRISPR-Cas effector protein and a deaminase domain (e.g., a fusion protein)) or the components for base editing (e.g., a CRISPR-Cas effector protein fused to a peptide tag or an affinity polypeptide, a deaminase domain fused to a peptide tag or an affinity polypeptide, and/or a UGI fused to a peptide tag or an affinity polypeptide), may be comprised on the same or on a separate expression cassette or vector from that comprising the one or more guide nucleic acids. When the nucleic acid construct encoding a base editor or the components for base editing is/are comprised on separate expression cassette(s) or vector(s) from that comprising the guide nucleic acid, a target nucleic acid may be contacted with (e.g., provided with) the expression cassette(s) or vector(s) encoding the base editor or components for base editing in any order from one another and the guide nucleic acid, e.g., prior to, concurrently with, or after the expression cassette comprising the guide nucleic acid is provided (e.g., contacted with the target nucleic acid).

Fusion proteins of the invention may comprise sequence-specific nucleic acid binding domains (e.g., sequence-specific DNA binding domains, CRISPR-Cas polypeptides, and/or deaminase domains fused to peptide tags or affinity polypeptides that interact with the peptide tags, as known in the art, for use in recruiting the deaminase to the target nucleic acid. Methods of recruiting may also comprise guide nucleic acids linked to RNA recruiting motifs and deaminases fused to affinity polypeptides capable of interacting with RNA recruiting motifs, thereby recruiting the deaminase to the target nucleic acid. Alternatively, chemical interactions may be used to recruit polypeptides (e.g., deaminases) to a target nucleic acid.

A peptide tag (e.g., epitope) useful with this invention may include, but is not limited to, a GCN4 peptide tag (e.g., Sun-Tag), a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope. Any epitope that may be linked to a polypeptide and for which there is a corresponding affinity polypeptide that may be linked to another polypeptide may be used with this invention as a peptide tag. In some embodiments, a peptide tag may comprise 1 or 2 or more copies of a peptide tag (e.g., repeat unit, multimerized epitope (e.g., tandem repeats)) (e.g., 1, 2, 3, 4, 5, 6, 7, 8, 9, 10, 11, 12, 13, 14, 15, 16, 17, 18, 19, 20, 21, 22, 23, 24, 25 or more repeat units. In some embodiments, an affinity polypeptide that interacts with/binds to a peptide tag may be an antibody. In some embodiments, the antibody may be a scFv antibody. In some embodiments, an affinity polypeptide that binds to a peptide tag may be synthetic (e.g., evolved for affinity interaction) including, but not limited to, an affibody, an anticalin, a monobody and/or a DARPin (see, e.g., Sha et al., *Protein Sci.* 26 (5): 910-924 (2017)); Gilbreth (*Curr Opin Struc Biol* 22 (4): 413-420 (2013)), U.S. Pat. No. 9,982,053, each of which are incorporated by reference in their entireties for the teachings relevant to affibodies, anticalins, monobodies and/or DARPins. Example peptide tag sequences and their affinity polypeptides include, but are not limited to, the amino acid sequences of SEQ ID NOs: 45-47.

In some embodiments, a guide nucleic acid may be linked to an RNA recruiting motif, and a polypeptide to be recruited (e.g., a deaminase) may be fused to an affinity polypeptide that binds to the RNA recruiting motif, wherein the guide binds to the target nucleic acid and the RNA recruiting motif binds to the affinity polypeptide, thereby recruiting the polypeptide to the guide and contacting the target nucleic acid with the polypeptide (e.g., deaminase). In some embodiments, two or more polypeptides may be recruited to a guide nucleic acid, thereby contacting the target nucleic acid with two or more polypeptides (e.g., deaminases). Example RNA recruiting motifs and their affinity polypeptides include, but are not limited to, the sequences of SEQ ID NOs: 48-58.

In some embodiments, a polypeptide fused to an affinity polypeptide may be a reverse transcriptase and the guide nucleic acid may be an extended guide nucleic acid linked to an RNA recruiting motif. In some embodiments, an RNA recruiting motif may be located on the 3' end of the extended portion of an extended guide nucleic acid (e.g., 5'-3', repeat-spacer-extended portion (RT template-primer binding site)-RNA recruiting motif). In some embodiments, an RNA recruiting motif may be embedded in the extended portion.

In some embodiments of the invention, an extended guide RNA and/or guide RNA may be linked to one or to two or more RNA recruiting motifs (e.g., 1, 2, 3, 4, 5, 6, 7, 8, 9, 10 or more motifs, e.g., at least 10 to about 25 motifs), optionally wherein the two or more RNA recruiting motifs may be the same RNA recruiting motif or different RNA recruiting motifs. In some embodiments, an RNA recruiting motif and corresponding affinity polypeptide may include, but is not limited, to a telomerase Ku binding motif (e.g., Ku binding hairpin) and the corresponding affinity polypeptide Ku (e.g., Ku heterodimer), a telomerase Sm7 binding motif and the corresponding affinity polypeptide Sm7, an MS2 phage operator stem-loop and the corresponding affinity polypeptide MS2 Coat Protein (MCP), a PP7 phage operator stem-loop and the corresponding affinity polypeptide PP7 Coat Protein (PCP), an SfMu phage Com stem-loop and the corresponding affinity polypeptide Com RNA binding protein, a PUF binding site (PBS) and the affinity polypeptide *Pumilio*/fem-3 mRNA binding factor (PUF), and/or a synthetic RNA-aptamer and the aptamer ligand as the corresponding affinity polypeptide. In some embodiments, the RNA recruiting motif and corresponding affinity polypeptide may be an MS2 phage operator stem-loop and the affinity polypeptide MS2 Coat Protein (MCP). In some embodiments, the RNA recruiting motif and corresponding affinity polypeptide may be a PUF binding site (PBS) and the affinity polypeptide *Pumilio*/fem-3 mRNA binding factor (PUF).

In some embodiments, the components for recruiting polypeptides and nucleic acids may those that function through chemical interactions that may include, but are not limited to, rapamycin-inducible dimerization of FRB-FKBP; Biotin-streptavidin; SNAP tag; Halo tag; CLIP tag;

DmrA-DmrC heterodimer induced by a compound; bifunctional ligand (e.g., fusion of two protein-binding chemicals together, e.g., dihyrofolate reductase (DHFR).

In some embodiments, the nucleic acid constructs, expression cassettes or vectors of the invention that are optimized for expression in a plant may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the nucleic acid constructs, expression cassettes or vectors comprising the same polynucleotide(s) but which have not been codon optimized for expression in a plant.

Further provided herein are cells comprising one or more polynucleotides, guide nucleic acids, nucleic acid constructs, expression cassettes or vectors of the invention.

Any plant comprising an endogenous CLE gene may be modified as described herein to increase kernel row number, optionally without substantially decreasing the length of the ears (e.g., ear length not reduced by more than 5-30%), and optionally to improve yield traits, in the plant. Non-limiting examples of plants that may be modified as described herein may include, but are not limited to, turf grasses (e.g., bluegrass, bentgrass, ryegrass, fescue), feather reed grass, tufted hair grass, *miscanthus, arundo*, switchgrass, vegetable crops, including artichokes, kohlrabi, arugula, leeks, asparagus, lettuce (e.g., head, leaf, romaine), malanga, melons (e.g., muskmelon, watermelon, crenshaw, honeydew, cantaloupe), cole crops (e.g., brussels sprouts, cabbage, cauliflower, broccoli, collards, kale, chinese cabbage, bok choy), cardoni, carrots, napa, okra, onions, celery, parsley, chick peas, parsnips, chicory, peppers, potatoes, cucurbits (e.g., marrow, cucumber, zucchini, squash, pumpkin, honeydew melon, watermelon, cantaloupe), radishes, dry bulb onions, rutabaga, eggplant, salsify, escarole, shallots, endive, garlic, spinach, green onions, squash, greens, beet (sugar beet and fodder beet), sweet potatoes, chard, horseradish, tomatoes, turnips, and spices; a fruit crop such as apples, apricots, cherries, nectarines, peaches, pears, plums, prunes, cherry, quince, fig, nuts (e.g., chestnuts, pecans, pistachios, hazelnuts, pistachios, peanuts, walnuts, macadamia nuts, almonds, and the like), citrus (e.g., clementine, kumquat, orange, grapefruit, tangerine, mandarin, lemon, lime, and the like), blueberries, black raspberries, boysenberries, cranberries, currants, gooseberries, loganberries, raspberries, strawberries, blackberries, grapes (wine and table), avocados, bananas, kiwi, persimmons, pomegranate, pineapple, tropical fruits, pomes, melon, mango, *papaya*, and lychee, a field crop plant such as clover, alfalfa, timothy, evening primrose, meadow foam, corn/maize (field, sweet, popcorn), hops, jojoba, buckwheat, safflower, *quinoa*, wheat, rice, barley, rye, millet, sorghum, oats, triticale, sorghum, tobacco, kapok, a leguminous plant (beans (e.g., green and dried), lentils, peas, soybeans), an oil plant (rape, canola, mustard, poppy, olive, sunflower, coconut, castor oil plant, cocoa bean, groundnut, oil palm), duckweed, *Arabidopsis*, a fiber plant (cotton, flax, hemp, jute), *Cannabis* (e.g., *Cannabis sativa, Cannabis indica*, and *Cannabis ruderalis*), lauraceae (cinnamon, camphor), or a plant such as coffee, sugar cane, tea, and natural rubber plants; and/or a bedding plant such as a flowering plant, a cactus, a succulent and/or an ornamental plant (e.g., roses, tulips, violets), as well as trees such as forest trees (broad-leaved trees and evergreens, such as conifers; e.g., elm, ash, oak, maple, fir, spruce, cedar, pine, birch, cypress, *eucalyptus*, willow), as well as shrubs and other nursery stock. In some embodiments, the nucleic acid constructs of the invention and/or expression cassettes and/or vectors encoding the same may be used to modify maize, soybean, wheat, canola, rice, tomato, pepper, or sunflower.

In some embodiments, a plant that may be modified as described herein may include, but is not limited to, corn, soybean, canola, wheat, rice, cotton, sugarcane, sugar beet, barley, oats, alfalfa, sunflower, safflower, oil palm, sesame, coconut, tobacco, potato, sweet potato, cassava, coffee, apple, plum, apricot, peach, cherry, pear, fig, banana, citrus, cocoa, avocado, olive, almond, walnut, strawberry, watermelon, pepper, grape, tomato, cucumber, or a *Brassica* spp (e.g., *B. napus, B. oleracea, B. rapa, B. juncea*, and/or *B. nigra*). In some embodiments, a plant that may be modified as described herein is a dicot. In some embodiments, a plant that may be modified as described herein is a monocot. In some embodiments, a plant that may be modified as described herein is corn (i.e., *Zea mays*). In some embodiments, a plant that may be modified as described herein is wheat (i.e., *Triticum* spp.).

Thus, plants or plant cultivars which are to be treated with preference in accordance with the invention include all plants which, through genetic modification, received genetic material which imparts particular advantageous useful properties ("traits") to these plants. Examples of such properties are better plant growth, vigor, stress tolerance, standability, lodging resistance, nutrient uptake, plant nutrition, and/or yield, in particular improved growth, increased tolerance to high or low temperatures, increased tolerance to drought or to levels of water or soil salinity, enhanced flowering performance, easier harvesting, accelerated ripening, higher yields, higher quality and/or a higher nutritional value of the harvested products, better storage life and/or processability of the harvested products.

Further examples of such properties are an increased resistance against animal and microbial pests, such as against insects, arachnids, nematodes, mites, slugs and snails owing, for example, to toxins formed in the plants. Among DNA sequences encoding proteins which confer properties of tolerance to such animal and microbial pests, in particular insects, mention will particularly be made of the genetic material from *Bacillus thuringiensis* encoding the Bt proteins widely described in the literature and well known to those skilled in the art. Mention will also be made of proteins extracted from bacteria such as *Photorhabdus* (WO97/17432 and WO98/08932). In particular, mention will be made of the Bt Cry or VIP proteins which include the CryIA, CryIAb, CryIAc, CryIIA, CryIIIA, CryIIIB2, Cry9c Cry2Ab, Cry3Bb and CryIF proteins or toxic fragments thereof and also hybrids or combinations thereof, especially the CryIF protein or hybrids derived from a CryIF protein (e.g. hybrid CryIA-CryIF proteins or toxic fragments thereof), the CryIA-type proteins or toxic fragments thereof, preferably the CryIAc protein or hybrids derived from the CryIAc protein (e.g. hybrid CryIAb-CryIAc proteins) or the CryIAb or Bt2 protein or toxic fragments thereof, the Cry2Ae, Cry2Af or Cry2Ag proteins or toxic fragments thereof, the CryIA. 105 protein or a toxic fragment thereof, the VIP3 Aa19 protein, the VIP3Aa20 protein, the VIP3A proteins produced in the COT202 or COT203 cotton events, the VIP3Aa protein or a toxic fragment thereof as described in Estruch et al. (1996), Proc Natl Acad Sci US A. 28;93 (11): 5389-94, the Cry proteins as described in WO2001/47952, the insecticidal proteins from Xenorhabdus (as described in WO98/50427), *Serratia* (particularly from *S. entomophila*) or *Photorhabdus* species strains, such as Tc-proteins from *Photorhabdus* as described in WO98/08932. Also any variants or mutants of any one of these proteins differing in some amino acids (1-10, preferably 1-5) from any of the above named sequences, particularly the sequence of their toxic fragment, or which are fused to a transit peptide, such as a plastid transit peptide, or another protein or peptide, is included herein.

Another and particularly emphasized example of such properties is conferred tolerance to one or more herbicides, for example imidazolinones, sulphonylureas, glyphosate or phosphinothricin. Among DNA sequences encoding proteins (i.e., polynucleotides of interest) which confer properties of tolerance to certain herbicides on the transformed plant cells and plants, mention will be particularly be made to the bar or PAT gene or the *Streptomyces coelicolor* gene described in WO2009/152359 which confers tolerance to glufosinate herbicides, a gene encoding a suitable EPSPS (5-Enolpyruvylshikimat-3-phosphat-Synthase) which confers tolerance to herbicides having EPSPS as a target, especially herbicides such as glyphosate and its salts, a gene encoding glyphosate-n-acetyltransferase, or a gene encoding glyphosate oxidoreductase. Further suitable herbicide tolerance traits include at least one ALS (acetolactate synthase) inhibitor (e.g., WO2007/024782), a mutated *Arabidopsis* ALS/AHAS gene (e.g., U.S. Pat. No. 6,855,533), genes encoding 2,4-D-monooxygenases conferring tolerance to 2,4-D (2,4-dichlorophenoxyacetic acid) and genes encoding Dicamba monooxygenases conferring tolerance to dicamba (3,6-dichloro-2-methoxybenzoic acid).

Further examples of such properties are increased resistance against phytopathogenic fungi, bacteria and/or viruses owing, for example, to systemic acquired resistance (SAR), systemin, phytoalexins, elicitors and also resistance genes and correspondingly expressed proteins and toxins.

Particularly useful transgenic events in transgenic plants or plant cultivars which can be treated with preference in accordance with the invention include Event 531/PV-GHBK04 (cotton, insect control, described in WO2002/040677), Event 1143-14A (cotton, insect control, not deposited, described in WO2006/128569); Event 1143-51B (cotton, insect control, not deposited, described in WO2006/128570); Event 1445 (cotton, herbicide tolerance, not deposited, described in US-A 2002-120964 or WO2002/034946); Event 17053 (rice, herbicide tolerance, deposited as PTA-9843, described in WO2010/117737); Event 17314 (rice, herbicide tolerance, deposited as PTA-9844, described in WO2010/117735); Event 281-24-236 (cotton, insect control-herbicide tolerance, deposited as PTA-6233, described in WO2005/103266 or US-A 2005-216969); Event 3006-210-23 (cotton, insect control-herbicide tolerance, deposited as PTA-6233, described in US-A 2007-143876 or WO2005/103266); Event 3272 (corn, quality trait, deposited as PTA-9972, described in WO2006/098952 or US-A 2006-230473); Event 33391 (wheat, herbicide tolerance, deposited as PTA-2347, described in WO2002/027004), Event 40416 (corn, insect control-herbicide tolerance, deposited as ATCC PTA-11508, described in WO 11/075593); Event 43A47 (corn, insect control-herbicide tolerance, deposited as ATCC PTA-11509, described in WO2011/075595); Event 5307 (corn, insect control, deposited as ATCC PTA-9561, described in WO2010/077816); Event ASR-368 (bent grass, herbicide tolerance, deposited as ATCC PTA-4816, described in US-A 2006-162007 or WO2004/053062); Event B16 (corn, herbicide tolerance, not deposited, described in US-A 2003-126634); Event BPS-CV127-9 (soybean, herbicide tolerance, deposited as NCIMB No. 41603, described in WO2010/080829); Event BLRI (oilseed rape, restoration of male sterility, deposited as NCIMB 41193, described in WO2005/074671), Event CE43-67B (cotton, insect control, deposited as DSM ACC2724, described in US-A 2009-217423 or WO2006/128573); Event CE44-69D (cotton, insect control, not deposited, described in US-A 2010-0024077); Event CE44-69D (cotton, insect control, not deposited, described in WO2006/128571); Event CE46-02A (cotton, insect control, not deposited, described in WO2006/128572); Event COT102 (cotton, insect control, not deposited, described in US-A 2006-130175 or WO2004/039986); Event COT202 (cotton, insect control, not deposited, described in US-A 2007-067868 or WO2005/054479); Event COT203 (cotton, insect control, not deposited, described in WO2005/054480);); Event DAS21606-3/1606 (soybean, herbicide tolerance, deposited as PTA-11028, described in WO2012/033794), Event DAS40278 (corn, herbicide tolerance, deposited as ATCC PTA-10244, described in WO2011/022469); Event DAS-44406-6/pDAB8264.44.06.1 (soybean, herbicide tolerance, deposited as PTA-11336, described in WO2012/075426), Event DAS-14536-7/pDAB8291.45.36.2 (soybean, herbicide tolerance, deposited as PTA-11335, described in WO2012/075429), Event DAS-59122-7 (corn, insect control-herbicide tolerance, deposited as ATCC PTA 11384, described in US-A 2006-070139); Event DAS-59132 (corn, insect control-herbicide tolerance, not deposited, described in WO2009/100188); Event DAS68416 (soybean, herbicide tolerance, deposited as ATCC PTA-10442, described in WO2011/066384 or WO2011/066360); Event DP-098140-6 (corn, herbicide tolerance, deposited as ATCC PTA-8296, described in US-A 2009-137395 or WO 08/112019); Event DP-305423-1 (soybean, quality trait, not deposited, described in US-A 2008-312082 or WO2008/054747); Event DP-32138-1 (corn, hybridization system, deposited as ATCC PTA-9158, described in US-A 2009-0210970 or WO2009/103049); Event DP-356043-5 (soybean, herbicide tolerance, deposited as ATCC PTA-8287, described in US-A 2010-0184079 or WO2008/002872); Event EE-I (brinjal, insect control, not deposited, described in WO 07/091277); Event Fil 17 (corn, herbicide tolerance, deposited as ATCC 209031, described in US-A 2006-059581 or WO 98/044140); Event FG72 (soybean, herbicide tolerance, deposited as PTA-11041, described in WO2011/063413), Event GA21 (corn, herbicide tolerance, deposited as ATCC 209033, described in US-A 2005-086719 or WO 98/044140); Event GG25 (corn, herbicide tolerance, deposited as ATCC 209032, described in US-A 2005-188434 or WO98/044140); Event GHB119 (cotton, insect control-herbicide tolerance, deposited as ATCC PTA-8398, described in WO2008/151780); Event GHB614 (cotton, herbicide tolerance, deposited as ATCC PTA-6878, described in US-A 2010-050282 or WO2007/017186); Event GJ11 (corn, herbicide tolerance, deposited as ATCC 209030, described in US-A 2005-188434 or WO98/044140); Event GM RZ13 (sugar beet, virus resistance, deposited as NCIMB-41601, described in WO2010/076212); Event H7-1 (sugar beet, herbicide tolerance, deposited as NCIMB 41158 or NCIMB 41159, described in US-A 2004-172669 or WO 2004/074492); Event JOPLINI (wheat, disease tolerance, not deposited, described in US-A 2008-064032); Event LL27 (soybean, herbicide tolerance, deposited as NCIMB41658, described in WO2006/108674 or US-A 2008-320616); Event LL55 (soybean, herbicide tolerance, deposited as NCIMB 41660, described in WO 2006/108675 or US-A 2008-196127); Event LLcotton25 (cotton, herbicide tolerance, deposited as ATCC PTA-3343, described in WO2003/013224 or US-A 2003-097687); Event LLRICE06 (rice, herbicide tolerance, deposited as ATCC 203353, described in U.S. Pat. No. 6,468,747 or WO2000/026345); Event LLRice62 (rice, herbicide tolerance, deposited as ATCC 203352, described in WO2000/026345), Event LLRICE601 (rice, herbicide tolerance, deposited as ATCC PTA-2600, described in US-A 2008-2289060 or WO2000/026356); Event LY038 (corn, quality trait, deposited as ATCC PTA-5623, described in US-A 2007-028322 or WO2005/061720); Event MIR162 (corn, insect control, deposited as PTA-8166, described in US-A 2009-300784 or WO2007/142840); Event MIR604 (corn, insect control, not deposited, described in US-A 2008-167456 or WO2005/103301); Event MON15985 (cotton, insect control, deposited as ATCC PTA-2516, described in US-A 2004-250317 or WO2002/100163); Event MON810 (corn, insect control, not deposited, described in US-A 2002-102582); Event MON863 (corn, insect control, deposited as ATCC PTA-2605, described in WO2004/011601 or US-A 2006-095986); Event MON87427 (corn, pollination control, deposited as ATCC PTA-7899, described in WO2011/062904); Event MON87460 (corn, stress tolerance, deposited as ATCC PTA-8910, described in WO2009/111263 or US-A 2011-0138504); Event MON87701 (soybean, insect control, deposited as ATCC PTA-8194, described in US-A 2009-130071 or WO2009/064652); Event MON87705 (soybean, quality trait-herbicide tolerance, deposited as ATCC PTA-9241, described in US-A 2010-0080887 or WO2010/037016); Event MON87708 (soybean, herbicide tolerance, deposited as ATCC PTA-9670, described in WO2011/034704); Event MON87712 (soybean, yield, deposited as PTA-10296, described in WO2012/051199), Event MON87754 (soybean, quality trait, deposited as ATCC PTA-9385, described in WO2010/024976); Event MON87769 (soybean, quality trait, deposited as ATCC PTA-8911, described in US-A 2011-0067141 or WO2009/102873); Event MON88017 (corn, insect control-herbicide tolerance, deposited as ATCC PTA-5582, described in US-A 2008-028482 or WO2005/059103); Event MON88913 (cotton, herbicide tolerance, deposited as ATCC PTA-4854, described in WO2004/072235 or US-A 2006-059590); Event MON88302 (oilseed rape, herbicide tolerance, deposited as PTA-10955, described in WO2011/153186), Event MON88701 (cotton, herbicide tolerance, deposited as PTA-11754, described in WO2012/134808), Event MON89034 (corn, insect control, deposited as ATCC PTA-7455, described in WO 07/140256 or US-A 2008-260932); Event MON89788 (soybean, herbicide tolerance, deposited as ATCC PTA-6708, described in US-A 2006-282915 or WO2006/130436); Event MS1 1 (oilseed rape, pollination control-herbicide tolerance, deposited as ATCC PTA-850 or PTA-2485, described in WO2001/031042); Event MS8 (oilseed rape, pollination control-herbicide tolerance, deposited as ATCC PTA-730, described in WO2001/041558 or US-A 2003-188347); Event NK603 (corn, herbicide tolerance, deposited as ATCC PTA-2478, described in US-A 2007-292854); Event PE-7 (rice, insect control, not deposited, described in WO2008/114282); Event RF3 (oilseed rape, pollination control-herbicide tolerance, deposited as ATCC PTA-730, described in WO2001/041558 or US-A 2003-188347); Event RT73 (oilseed rape, herbicide tolerance, not deposited, described in WO2002/036831 or US-A 2008-070260); Event SYHTOH2/SYN-000H2-5 (soybean, herbicide tolerance, deposited as PTA-11226, described in WO2012/082548), Event T227-1 (sugar beet, herbicide tolerance, not deposited, described in WO2002/44407 or US-A 2009-265817); Event T25 (corn, herbicide tolerance, not deposited, described in US-A 2001-029014 or WO2001/051654); Event T304-40 (cotton, insect control-herbicide tolerance, deposited as ATCC PTA-8171, described in US-A 2010-077501 or WO2008/122406); Event T342-142 (cotton, insect control, not deposited, described in WO2006/128568); Event TC1507 (corn, insect control-herbicide tolerance, not deposited, described in US-A 2005-039226 or WO2004/099447); Event VIP1034 (corn, insect control-herbicide tolerance, deposited as ATCC PTA-3925, described in WO2003/052073), Event 32316 (corn, insect control-herbicide tolerance, deposited as PTA-11507, described in WO2011/084632), Event 4114 (corn, insect control-herbicide tolerance, deposited as PTA-11506, described in WO2011/084621), event EE-GM3/FG72 (soybean, herbicide tolerance, ATCC Accession N° PTA-11041) optionally stacked with event EE-GM1/LL27 or event EE-GM2/LL55 (WO2011/063413A2), event DAS-68416-4 (soybean, herbicide tolerance, ATCC Accession N° PTA-10442, WO2011/066360A1), event DAS-68416-4 (soybean, herbicide tolerance, ATCC Accession N° PTA-10442, WO2011/066384A1), event DP-040416-8 (corn, insect control, ATCC Accession N° PTA-11508, WO2011/075593A1), event DP-043A47-3 (corn, insect control, ATCC Accession N° PTA-11509, WO2011/075595A1), event DP-004114-3 (corn, insect control, ATCC Accession N° PTA-11506, WO2011/084621A1), event DP-032316-8 (corn, insect control, ATCC Accession N° PTA-11507, WO2011/084632A1), event MON-88302-9 (oilseed rape, herbicide tolerance, ATCC Accession N° PTA-10955, WO2011/153186A1), event DAS-21606-3 (soybean, herbicide tolerance, ATCC Accession No. PTA-11028, WO2012/033794A2), event MON-87712-4 (soybean, quality trait, ATCC Accession N°. PTA-10296, WO2012/051199A2), event DAS-44406-6 (soybean, stacked herbicide tolerance, ATCC Accession N°. PTA-11336, WO2012/075426A1), event DAS-14536-7 (soybean, stacked herbicide tolerance, ATCC Accession N°. PTA-11335, WO2012/075429A1), event SYN-000H2-5 (soybean, herbicide tolerance, ATCC Accession N°. PTA-11226, WO2012/082548A2), event DP-061061-7 (oilseed rape, herbicide tolerance, no deposit N° available, WO2012071039A1), event DP-073496-4 (oilseed rape, herbicide tolerance, no deposit N° available, US2012131692), event 8264.44.06.1 (soybean, stacked herbicide tolerance, Accession N° PTA-11336, WO2012075426A2), event 8291.45.36.2 (soybean, stacked herbicide tolerance, Accession N°. PTA-11335, WO2012075429A2), event SYH-TOH2 (soybean, ATCC Accession N°. PTA-11226, WO2012/082548A2), event MON88701 (cotton, ATCC Accession N° PTA-11754, WO2012/134808A1), event KK179-2 (alfalfa, ATCC Accession N° PTA-11833, WO2013/003558A1), event pDAB8264.42.32.1 (soybean, stacked herbicide tolerance, ATCC Accession N° PTA-11993, WO2013/010094A1), event MZDT09Y (corn, ATCC Accession N° PTA-13025, WO2013/012775A1).

The genes/events (e.g., polynucleotides of interest), which impart the desired traits in question, may also be present in combinations with one another in the transgenic plants. Examples of transgenic plants which may be mentioned are the important crop plants, such as cereals (wheat, rice, triticale, barley, rye, oats), maize, soya beans, potatoes, sugar beet, sugar cane, tomatoes, peas and other types of vegetable, cotton, tobacco, oilseed rape and also fruit plants (with the fruits apples, pears, citrus fruits and grapes), with particular emphasis being given to maize, soya beans, wheat, rice, potatoes, cotton, sugar cane, tobacco and oilseed rape. Traits which are particularly emphasized are the increased resistance of the plants to insects, arachnids, nematodes and slugs and snails, as well as the increased resistance of the plants to one or more herbicides.

Commercially available examples of such plants, plant parts or plant seeds that may be treated with preference in accordance with the invention include commercial products, such as plant seeds, sold or distributed under the GENUITY®, DROUGHTGARD®, SMARTSTAX®, RIB COMPLETER, ROUNDUP READY®, VT DOUBLE PRO®, VT TRIPLE PRO®, BOLLGARD IIR, ROUNDUP READY 2 YIELD®, YIELDGARD®, ROUNDUP READY® 2 XTENDTM, INTACTA RR2 PRO®, VISTIVE GOLD®, and/or XTENDFLEX™ trade names.

The invention will now be described with reference to the following examples. It should be appreciated that these examples are not intended to limit the scope of the claims to the invention but are rather intended to be exemplary of certain embodiments. Any variations in the exemplified methods that occur to the skilled artisan are intended to fall within the scope of the invention.

EXAMPLES

Example 1. Design of the Editing Constructs for LRR-RLK Editing

The genomic sequences of the LRR-RLK genes with close phylogenetic relationships to known meristem regulators were identified in a proprietary maize line. (See Table 1) From these reference sequences, spacer sequences (SEQ ID NOs: 243-266) were designed for use in editing constructs. The editing constructs contained a CRISPR-Cas effector and a spacer sequence designed to target the specified LRR-RLK gene. (See Table 2 for spacers correlated to target sequences) Spacers were deployed with either a Cas-effector cutting enzyme or a Cas-effector base editing complex.

TABLE 1

LRR-RLK Genes

| Target Gene | LOCUS Identifier | SEQ ID NO. |
|---|---|---|
| II CIK4 small-Zm00001d037840 | LOCUS68 | SEQ ID NO. 228 |
| XI BAM1-2-Zm00001d028317 | LOCUS69 | SEQ ID NO. 229 |
| XI BAM3-like-Zm00001d048968 | LOCUS70 | SEQ ID NO. 230 |
| II CIK4 small-Zm00001d036887 | LOCUS71 | SEQ ID NO. 231 |
| XI BAM3-like-Zm00001d007254 | LOCUS72 | SEQ ID NO. 232 |
| XI BAM1-2-Zm00001d018752 | LOCUS73 | SEQ ID NO. 233 |
| II NIK3 like-Zm00001d039678 | LOCUS74 | SEQ ID NO. 234 |
| XI BAM3-Zm00001d039218 | LOCUS75 | SEQ ID NO. 235 |
| XI BAM1-2-Zm00001d034240 | LOCUS76 | SEQ ID NO. 236 |
| II NIK1-2-Zm00001d017913 | LOCUS77 | SEQ ID NO. 237 |
| XI BAM1-2-Zm00001d013162 | LOCUS78 | SEQ ID NO. 238 |
| II NIK3-Zm00001d008724 | LOCUS79 | SEQ ID NO. 239 |
| II CIK4-Zm00001d016197 | LOCUS80 | SEQ ID NO. 240 |
| XV RPK1-2-Zm00001d022066 | LOCUS81 | SEQ ID NO. 241 |
| XIIa SOS1-Zm00001d048832 | LOCUS82 | SEQ ID NO. 242 |

TABLE 2

Vectors, Spacers and Target Loci for LRR-RLK Gene Editing

| Vector | Spacer | Spacer SEQ ID | Spacer Sequence | Target Locus (SEQ ID No.) |
|---|---|---|---|---|
| pWISE948 | PWsp96 | 243 | AACAGTTCCGCGCACAGCTG | LOCUS77 |
| pWISE954 | PWsp102 | 244 | GGGCTCGCCAAGTTCCTCCG | LOCUS69 |
| pWISE2711 | PWsp1122 | 245 | GAGTGCATGTCCGCTATCGCCGG | LOCUS69 |
| pWISE2219 | PWsp654 | 246 | GGGCTCGCCAAGTTCTTGCAGGA | LOCUS73 |
| pWISE2710 | PWsp1121 | 247 | GTGACCAGCTCCAGGAGCACCAC | LOCUS73 |
| pWISE2713 | PWsp1124 | 248 | GCGCCACCTCCGAGTGCATGTCC | LOCUS70 |
| pWISE2704 | PWsp1115 | 249 | GCCAATCCAAAATCCCCGACGAT | LOCUS80 |
| pWISE2705 | PWSp1116 | 250 | AAGCTCATGTGGCCGACTTTGGG | LOCUS76 |
| pWISE2706 | PWsp1117 | 251 | AATAGGAGAATGCCAATCCCATA | LOCUS68 |
| pWISE2707 | PWsp1118 | 252 | CGGTGGTCTAGGAGCTTTGCAAG | LOCUS77 |
| pWISE2708 | PWsp1119 | 253 | GTGACCAGCTCGACTAGCAGAAC | LOCUS79 |
| pWISE3073 | PWsp1173 | 254 | GATTGGCGAAACTTCTTGACCGT | LOCUS80 |
| pWISE3263 | PWsp1198 | 255 | GGCTAGCAAAATTCTTGCAGGAC | LOCUS76 |
| pWISE3265 | PWsp1199 | 256 | GGCTGGCCAAGTTCCTGGGCGGC | LOCUS75 |
| pWISE3264 | PWsp1200 | 257 | GAATTGCAAAGATTCTTAGAGAC | LOCUS82 |

TABLE 2-continued

Vectors, Spacers and Target Loci for LRR-RLK Gene Editing

| Vector | Spacer | Spacer SEQ ID | Spacer Sequence | Target Locus (SEQ ID No.) |
|---|---|---|---|---|
| pWISE3266 | PWsp1201 | 258 | ATTGTTCCCCTTATCCCGGTGCC | LOCUS82 |
| pWISE3267 | PWsp1202 | 259 | GACTGGCGAAGCTCCTGGACCAC | LOCUS79 |
| pWISE3301 | PWsp1217 | 260 | GATAAAGCTGATGTGTATAGCTA | LOCUS81 |
| pWISE2221 | PWsp648 | 261 | GGCTCGCCAAGTTCCTCCGCTCC | LOCUS70 |
| pWISE2222 | PWsp649 | 262 | GCCTCGCCAAGTTCCTCCGGTGC | LOCUS72 |
| pWISE2223 | PWsp650 | 263 | GGCTCGCCAAGTTCCTCCGGGGC | LOCUS69 |
| pWISE2225 | PWsp652 | 264 | GGCTGGCGAAACTCCTGGACCAC | LOCUS74 |
| pWISE2227 | PWsp655 | 265 | GCCATAGGAGCCTGCAATGGCAG | LOCUS73 |
| pWISE1752 | PWsp671 | 266 | TACAAACACAAGAGATTCCTGTG | LOCUS71 |

Example 2. Transformation and Selection of Edited E0 Plants

A vector encoding a selected spacer as well as the chosen CRISPR-Cas effector were introduced into dried excised maize embryos using *Agrobacterium*. Transformed tissue was maintained in vitro with antibiotic selection to regenerate positive transformants. Healthy non-chimeric plants (E0) were selected and plugged in growth trays. Tissue was collected from regenerating plants (E0 generation) for DNA extraction and subsequent molecular screening was employed to identify edits in the selected LRR-RLK gene. Plants identified to be (1) healthy, non-chimeric and fertile, with (2) low transgene copy and (3) desired edits in the kinase domain were advanced to the next generation. E0 plants that satisfied all the above criteria were selfed to produce the E1 generation. Table 3 contains sequence information on edits obtained in various LRR-RLKs. The Edit Locus Annotation column describes the edit in relation to the genomic sequence of the identified locus (See Table 1 for LOCUS-SEQ ID NO. correlation). For example, row 1 describes two cytosine to thymine changes occurring at positions 2505 and 2507 of LOCUS 69 (SEQ ID NO. 229). Row 3 describes a 21nt deletion occurring at position 3870 of LOCUS80 (SEQ ID NO. 240).

TABLE 3

Edits obtained in LRR-RLKs

| Spacer | Locus | Edit Locus Annotation |
|---|---|---|
| PWsp102 | LOCUS69 | 2505: C > T; 2507: C > T |
| PWsp102 | LOCUS69 | 2505: C > T; 2507: C > T; 2508: C > T |
| PWsp1115 | LOCUS80 | 3870: 21D |
| PWsp1115 | LOCUS80 | 3878: 9D |
| PWsp1115 | LOCUS80 | 3879: 29D |
| PWsp1115 | LOCUS80 | 3880: 10D |
| PWsp1115 | LOCUS80 | 3880: 11D |
| PWsp1115 | LOCUS80 | 3880: 14D |
| PWsp1115 | LOCUS80 | 3880: 6D |
| PWsp1115 | LOCUS80 | 3881: 12D |
| PWsp1115 | LOCUS80 | 3881: 13D |

TABLE 3-continued

Edits obtained in LRR-RLKs

| Spacer | Locus | Edit Locus Annotation |
|---|---|---|
| PWsp1115 | LOCUS80 | 3881: 49D |
| PWsp1115 | LOCUS80 | 3882: 3D |
| PWsp1115 | LOCUS80 | 3886: 3D |
| PWsp1116 | LOCUS76 | 2640: 95D |
| PWsp1116 | LOCUS76 | 2711: 25D |
| PWsp1116 | LOCUS76 | 2719: 17D |
| PWsp1116 | LOCUS76 | 2724: 12D |
| PWsp1116 | LOCUS76 | 2725: 11D |
| PWsp1116 | LOCUS76 | 2726: 13D |
| PWsp1116 | LOCUS76 | 2727: 14D |
| PWsp1116 | LOCUS76 | 2727: 18D |
| PWsp1116 | LOCUS76 | 2728: 27D |
| PWsp1116 | LOCUS76 | 2728: 7D |
| PWsp1116 | LOCUS76 | 2728: 8D |
| PWsp1116 | LOCUS76 | 2730: 6D |
| PWsp1116 | LOCUS76 | 2730: 7D |
| PWsp1116 | LOCUS76 | 2731: 16D |
| PWsp1116 | LOCUS76 | 2731: 1D |
| PWsp1116 | LOCUS76 | 2731: 3D |
| PWsp1116 | LOCUS76 | 2731: 5D |
| PWsp1116 | LOCUS76 | 2732: 3D |
| PWsp1116 | LOCUS76 | 2732: 6D |
| PWsp1116 | LOCUS76 | 2733: 3D |
| PWsp1116 | LOCUS76 | 2734: 1D |
| PWsp1117 | LOCUS68 | 1617: 18D |
| PWsp1117 | LOCUS68 | 1619: 15D |
| PWsp1117 | LOCUS68 | 1623: 11D |
| PWsp1117 | LOCUS68 | 1623: 13D |
| PWsp1117 | LOCUS68 | 1623: 16D |
| PWsp1117 | LOCUS68 | 1625: 12D |
| PWsp1117 | LOCUS68 | 1625: 21D |
| PWsp1117 | LOCUS68 | 1627: 9D |
| PWsp1117 | LOCUS68 | 1627: 9D |
| PWsp1117 | LOCUS68 | 1628: 5D |
| PWsp1117 | LOCUS68 | 1628: 8D |
| PWsp1117 | LOCUS68 | 1629: 5D |
| PWsp1117 | LOCUS68 | 1629: 6D |
| PWsp1117 | LOCUS68 | 1631: 6D |
| PWsp1117 | LOCUS68 | 1631: 6D |
| PWsp1118 | LOCUS77 | 3422: 7D |
| PWsp1118 | LOCUS77 | 3423: 9D |
| PWsp1118 | LOCUS77 | 3424: 7D |
| PWsp1118 | LOCUS77 | 3425: 5D |

TABLE 3-continued

Edits obtained in LRR-RLKs

| Spacer | Locus | Edit Locus Annotation |
|---|---|---|
| PWsp1118 | LOCUS77 | 3425: 8D |
| PWsp1118 | LOCUS77 | 3427: 5D |
| PWsp1118 | LOCUS77 | 3429: 1D |
| PWsp1119 | LOCUS79 | 3848: 15D |
| PWsp1119 | LOCUS79 | 3852: 10D |
| PWsp1119 | LOCUS79 | 3853: 112D |
| PWsp1119 | LOCUS79 | 3853: 9D |
| PWsp1119 | LOCUS79 | 3854: 6D |
| PWsp1119 | LOCUS79 | 3854: 6D |
| PWsp1119 | LOCUS79 | 3854: 7D |
| PWsp1119 | LOCUS79 | 3854: 8D |
| PWsp1119 | LOCUS79 | 3856: 3D |
| PWsp1121 | LOCUS73 | 2987: 12D |
| PWsp1121 | LOCUS73 | 2987: 26D |
| PWsp1121 | LOCUS73 | 2991: 13D |
| PWsp1121 | LOCUS73 | 2992: 96D |
| PWsp1121 | LOCUS73 | 2993: 10D |
| PWsp1121 | LOCUS73 | 2994: 10D |
| PWsp1121 | LOCUS73 | 2995: 11D |
| PWsp1121 | LOCUS73 | 2996: 15D |
| PWsp1121 | LOCUS73 | 2996: 1I(N) |
| PWsp1121 | LOCUS73 | 2996: 6D |
| PWsp1121 | LOCUS73 | 2996: 71D |
| PWsp1121 | LOCUS73 | 2996: 7D |
| PWsp1121 | LOCUS73 | 2996: 8D |
| PWsp1121 | LOCUS73 | 2996: 8D |
| PWsp1121 | LOCUS73 | 2996: 9D |
| PWsp1121 | LOCUS73 | 2997: 10D |
| PWsp1121 | LOCUS73 | 2997: 7D |
| PWsp1121 | LOCUS73 | 2999: 4D |
| PWsp1121 | LOCUS73 | 3000: 4D |
| PWsp1121 | LOCUS73 | 3001: 10D |
| PWsp1121 | LOCUS73 | 3001: 2D |
| PWsp1122 | LOCUS69 | 2549: 9D |
| PWsp1122 | LOCUS69 | 2551: 10D |
| PWsp1122 | LOCUS69 | 2552: 11D |
| PWsp1122 | LOCUS69 | 2552: 12D |
| PWsp1122 | LOCUS69 | 2552: 12D |
| PWsp1122 | LOCUS69 | 2552: 16D |
| PWsp1122 | LOCUS69 | 2554: 6D |
| PWsp1122 | LOCUS69 | 2555: 6D |
| PWsp1124 | LOCUS70 | 2596: 12D |
| PWsp1124 | LOCUS70 | 2597: 15D |
| PWsp1124 | LOCUS70 | 2601: 10D |
| PWsp1124 | LOCUS70 | 2602: 15D |
| PWsp1124 | LOCUS70 | 2602: 4D |
| PWsp1124 | LOCUS70 | 2603: 8D |
| PWsp1173 | LOCUS80 | 3903: C > T |
| PWsp1173 | LOCUS80 | 3908: C > T |
| PWsp1173 | LOCUS71 | 888: A > G; 946: T > C; 950: A > G |
| PWsp1198 | LOCUS76 | 2741: C > G |
| PWsp1198 | LOCUS76 | 2741: C > G; 2748: C > T |
| PWsp1198 | LOCUS76 | 2741: C > T |
| PWsp1198 | LOCUS76 | 2741: C > T; 2748: C > T |
| PWsp1198 | LOCUS76 | 2741: C > T; 2748: C > T; 2752: C > T |
| PWsp1198 | LOCUS76 | 2741: C > T; 2770: G > A |
| PWsp1198 | LOCUS76 | 2748: C > T |
| PWsp1198 | LOCUS76 | 2770: G > A |
| PWsp1199 | LOCUS75 | 2712: G > A; 2713: G > A |
| PWsp1199 | LOCUS75 | 2712: G > C |
| PWsp1199 | LOCUS75 | 2726: C > T; 2727: C > G; 2733: C > A |
| PWsp1199 | LOCUS75 | 2726: C > T; 2727: C > T; 2733: C > T |
| PWsp1199 | LOCUS75 | 2726: C > T; 2727: C > T; 2733: C > T; 2734: C > T |
| PWsp1199 | LOCUS75 | 2726: C > T; 2727: C > T; 2733: C > T; 2734: C > T; 2739: C > T |
| PWsp1199 | LOCUS75 | 2727: C > T |
| PWsp1199 | LOCUS75 | 2727: C > T; 2733: C > T; 2734: C > T |
| PWsp1200 | LOCUS82 | 2714: C > G |
| PWsp1200 | LOCUS82 | 2714: C > T |
| PWsp1201 | LOCUS82 | 2768: C > T |
| PWsp1201 | LOCUS82 | 2774: 4I(GCAC) |
| PWsp1201 | LOCUS82 | 2777: C > T |
| PWsp1201 | LOCUS82 | 2779: G > A; 2780: G > A; 2781: G > A; 2786: G > A; 2787: G > A; 2788: G > A; 2789: G > A |
| PWsp1201 | LOCUS82 | 2779: G > A; 2780: G > A; 2781: G > A; 2786: G > A; 2787: G > A; 2788: G > A; 2789: G > A; 2797: G > A |
| PWsp1201 | LOCUS82 | 2779: G > A; 2780: G > C; 2781: G > A; 2786: G > A; 2787: G > A; 2788: G > C; 2789: G > A |
| PWsp1201 | LOCUS82 | 2779: G > A; 2786: 2D; 2789: G > A |
| PWsp1201 | LOCUS82 | 2781: G > A; 2786: G > A; 2787: G > A; 2788: G > A; 2789: G > A |
| PWsp1201 | LOCUS82 | 2786: G > A; 2787: G > A; 2788: G > A; 2789: G > A |
| PWsp1202 | LOCUS79 | 3720: C > T; 3735: C > G; 3736: C > T; 3748: G > A; 3766: G > A |
| PWsp1202 | LOCUS79 | 3728: C > T |
| PWsp1202 | LOCUS79 | 3728: C > T; 3733: C > G |
| PWsp1202 | LOCUS79 | 3728: C > T; 3733: C > T; 3735: C > T |
| PWsp1202 | LOCUS79 | 3728: C > T; 3733: C > T; 3735: C > T; 3748: G > A; 3766: G > A |
| PWsp1202 | LOCUS79 | 3728: C > T; 3735: C > T; 3736: C > T |
| PWsp1202 | LOCUS79 | 3729: G > C |
| PWsp1217 | LOCUS81 | 2882: 21D |
| PWsp1217 | LOCUS81 | 2889: 15D |
| PWsp1217 | LOCUS81 | 2890: 19D |
| PWsp1217 | LOCUS81 | 2891: 12D |
| PWsp1217 | LOCUS81 | 2891: 14D |
| PWsp1217 | LOCUS81 | 2892: 2D |
| PWsp1217 | LOCUS81 | 2893: 11D |
| PWsp1217 | LOCUS81 | 2894: 10D |
| PWsp1217 | LOCUS81 | 2894: 8D |
| PWsp1217 | LOCUS81 | 2894: 9D |
| PWsp1217 | LOCUS81 | 2894: 9D |
| PWsp1217 | LOCUS81 | 2895: 11D |
| PWsp1217 | LOCUS81 | 2895: 14D |
| PWsp1217 | LOCUS81 | 2895: 1D |
| PWsp1217 | LOCUS81 | 2895: 5D |
| PWsp1217 | LOCUS81 | 2895: 74D |
| PWsp1217 | LOCUS81 | 2895: 8D |
| PWsp1217 | LOCUS81 | 2895: 9D |
| PWsp1217 | LOCUS81 | 2896: 10D |
| PWsp1217 | LOCUS81 | 2896: 7D |
| PWsp1217 | LOCUS81 | 2896: 8D |
| PWsp1217 | LOCUS81 | 2896: 9D |
| PWsp648 | LOCUS70 | 2554: G > A; 2557: G > A; 2570: C > T; 2571: C > T; 2577: C > T; 2578: C > T; 2580: C > T; 2581: C > T |
| PWsp648 | LOCUS70 | 2557: G > A |
| PWsp648 | LOCUS70 | 2557: G > A; 2570: C > T; 2571: C > T; 2577: C > T; 2578: C > T |
| PWsp648 | LOCUS70 | 2568: C > T; 2570: C > T; 2571: C > T; 2577: C > T; 2578: C > T |
| PWsp648 | LOCUS70 | 2570: C > T; 2571: C > A; 2577: 2D; 2580: C > T |
| PWsp648 | LOCUS70 | 2570: C > T; 2571: C > G; 2577: C > G |
| PWsp648 | LOCUS70 | 2570: C > T; 2571: C > G; 2577: C > G; 2578: C > T; 2580: C > T; 2581: C > T |
| PWsp648 | LOCUS70 | 2570: C > T; 2571: C > T |
| PWsp648 | LOCUS70 | 2570: C > T; 2571: C > T; 2577: C > T |
| PWsp648 | LOCUS70 | 2570: C > T; 2571: C > T; 2577: C > T; 2578: C > T |
| PWsp648 | LOCUS70 | 2570: C > T; 2571: C > T; 2577: C > T; 2578: C > T; 2580: C > T; 2581: C > T |
| PWsp648 | LOCUS70 | 2570: C > T; 2571: C > T; 2577: C > T; 2578: C > T; 2582: G > A; 2585: C > T; 2586: C > T |
| PWsp648 | LOCUS70 | 2571: C > G |
| PWsp648 | LOCUS70 | 2571: C > T |
| PWsp648 | LOCUS70 | 2571: C > T; 2577: C > T |
| PWsp648 | LOCUS70 | 2571: C > T; 2577: C > T; 2578: C > T |
| PWsp648 | LOCUS70 | 2571: C > T; 2577: C > T; 2578: C > T; 2580: C > T; 2581: C > T |
| PWsp648 | LOCUS70 | 2577: C > T; 2578: C > T |
| PWsp649 | LOCUS72 | 2553: G > A |
| PWsp649 | LOCUS72 | 2558: C > G; 2566: C > T; 2567: C > G |
| PWsp649 | LOCUS72 | 2558: C > G; 2566: C > T; 2567: C > G; 2583: G > A |
| PWsp649 | LOCUS72 | 2564: C > T; 2566: C > T; 2567: C > T; 2573: C > T; 2574: C > T; 2576: C > T; 2577: C > T |
| PWsp649 | LOCUS72 | 2564: C > T; 2567: C > T |
| PWsp649 | LOCUS72 | 2566: C > T; 2567: C > G |
| PWsp649 | LOCUS72 | 2566: C > T; 2567: C > T |

TABLE 3-continued

Edits obtained in LRR-RLKs

| Spacer | Locus | Edit Locus Annotation |
|---|---|---|
| PWsp649 | LOCUS72 | 2566: C > T; 2567: C > T; 2573: C > T |
| PWsp649 | LOCUS72 | 2566: C > T; 2567: C > T; 2573: C > T; 2574: C > T |
| PWsp649 | LOCUS72 | 2566: C > T; 2567: C > T; 2573: C > T; 2574: C > T; 2576: C > T; 2577: C > T |
| PWsp649 | LOCUS72 | 2567: C > T; 2576: C > T |
| PWsp649 | LOCUS72 | 2567: C > T; 2586: G > A |
| PWsp650 | LOCUS69 | 2490: C > T; 2507: C > T; 2508: C > A; 2514: 1D; 2515: C > T; 2517: C > T; 2518: C > T |
| PWsp650 | LOCUS69 | 2493: G > A; 2507: C > T; 2508: C > G |
| PWsp650 | LOCUS69 | 2493: G > A; 2507: C > T; 2508: C > T; 2514: C > T |
| PWsp650 | LOCUS69 | 2499: 19D |
| PWsp650 | LOCUS69 | 2499: C > T; 2507: C > T; 2508: C > T; 2514: C > T; 2515: C > T; 2517: C > T; 2518: C > T |
| PWsp650 | LOCUS69 | 2502: G > A |
| PWsp650 | LOCUS69 | 2502: G > C; 2529: C > T |
| PWsp650 | LOCUS69 | 2505: C > T; 2507: C > T; 2508: C > G; 2514: C > T; 2515: C > G |
| PWsp650 | LOCUS69 | 2507: C > T; 2508: C > G; 2512: 1I(T); 2514: C > T; 2517: C > A |
| PWsp650 | LOCUS69 | 2507: C > T; 2508: C > T; 2514: 2D |
| PWsp650 | LOCUS69 | 2507: C > T; 2508: C > T; 2514: C > G; 2515: C > T; 2517: C > T; 2518: C > T |
| PWsp650 | LOCUS69 | 2507: C > T; 2508: C > T; 2514: C > T |
| PWsp650 | LOCUS69 | 2507: C > T; 2508: C > T; 2514: C > T; 2515: C > T |
| PWsp650 | LOCUS69 | 2507: C > T; 2508: C > T; 2514: C > T; 2515: C > T; 2517: C > T |
| PWsp650 | LOCUS69 | 2507: C > T; 2508: C > T; 2514: C > T; 2515: C > T; 2517: C > T; 2518: C > T |
| PWsp650 | LOCUS69 | 2508: C > T; 2514: C > T; 2515: C > T; 2517: C > T; 2518: C > T |
| PWsp652 | LOCUS74 | 3603: G > A; 3616: C > T; 3623: C > T; 3624: C > T; 3656: G > A |
| PWsp652 | LOCUS74 | 3608: C > T; 3616: C > T; 3617: G > A |
| PWsp652 | LOCUS74 | 3616: 1D; 3623: C > T; 3624: C > G |
| PWsp652 | LOCUS74 | 3616: C > T |
| PWsp652 | LOCUS74 | 3616: C > T; 3621: C > T |
| PWsp652 | LOCUS74 | 3616: C > T; 3621: C > T; 3623: C > T |
| PWsp652 | LOCUS74 | 3616: C > T; 3621: C > T; 3623: C > T; 3624: C > T |
| PWsp652 | LOCUS74 | 3616: C > T; 3623: C > T |
| PWsp652 | LOCUS74 | 3616: C > T; 3623: C > T; 3624: C > G; 3630: C > G |
| PWsp652 | LOCUS74 | 3616: C > T; 3623: C > T; 3624: C > T |
| PWsp652 | LOCUS74 | 3617: G > A |
| PWsp652 | LOCUS74 | 3621: 1D; 3623: C > T; 3624: C > T |
| PWsp652 | LOCUS74 | 3621: C > T; 3623: C > T |
| PWsp652 | LOCUS74 | 3623: C > T |
| PWsp652 | LOCUS74 | 3624: C > T |
| PWsp652 | LOCUS74 | 3633: G > A |
| PWsp652 | LOCUS74 | 3635: G > A; 3636: G > C |
| PWsp652 | LOCUS74 | 3636: G > A |
| PWsp654 | LOCUS73 | 2570: C > T; 2611: G > T; 2613: G > A; 2639: A > T |
| PWsp654 | LOCUS73 | 2582: C > T; 2586: C > T; 2588: C > T; 2590: C > T; 2591: C > T |
| PWsp654 | LOCUS73 | 2588: C > T; 2590: C > T; 2591: C > T |
| PWsp654 | LOCUS73 | 2588: C > T; 2590: C > T; 2591: C > T; 2597: C > T |
| PWsp655 | LOCUS73 | 2611: G > T; 2613: G > A; 2639: A > T |
| PWsp671 | LOCUS71 | 426: 14D |
| PWsp671 | LOCUS71 | 430: 13D |
| PWsp671 | LOCUS71 | 430: 9D |
| PWsp671 | LOCUS71 | 431: 9D |
| PWsp671 | LOCUS71 | 432: 6D |
| PWsp96 | LOCUS77 | 3426: T > C; 3429: A > G; 3438: A > G; 3453: G > A; 3468: T > C; 3474: C > G; 3498: C > T |
| PWsp96 | LOCUS77 | 3475: G > A; 3476: G > A |
| PWsp96 | LOCUS77 | 3476: G > A |
| PWsp96 | LOCUS77 | 3476: G > C |

Example 3. Phenotypic Assessment of Trait Activity

E1 seeds were sown in flats and later transferred to pots after seedlings were established. All materials were cultivated under standard greenhouse conditions and grown to reproductive maturity. Following standard practices, emerging ears were covered with small paper bags prior to the emergence of silk and tassels were covered during anthesis for the capture of pollen on a plant-by-plant basis. All ears were removed from the plants after dry-down.

After ear harvest and dry-down, kernel row number was manually counted for all ears. Data represent the average of three row counts per ear taken from the mid-section of the ear where row lineages were most defined. In order to prevent double counting of rows, a marker (e.g., paper clip) was inserted in between the rows where the counts initiated and to designate where row counting should cease. Unedited germplasm, and lines transformed with a Gus plasmid were used as wild-type controls for phenotyping. Table 4 shows kernel row number (KRN) for E1 derived from selfed E0 ears.

TABLE 4

LRR-RLK Edits and KRN Phenotype Measurements

| Vector | Target Locus (SEQ ID No.) | Allele Locus Annotation | Allele Description | KRN Average | Sample Size |
|---|---|---|---|---|---|
| pWISE948 | LOCUS77 | 3475: G > A; 3476: G > A Homo | Homo G > K | 17.23 | 13 |
| pWISE948 | LOCUS77 | 3475: G > A; 3476: G > A Het | Het G > K | 16.89 | 9 |
| pWISE948 | LOCUS77 | 3476: G > A Homo | Homo G > E | 18 | 5 |
| pWISE948 | LOCUS77 | 3475: G > A; 3476: G > A, 3476: G > A Compound Het | Compound Het G > E, G > K | 17.86 | 14 |
| pWISE948 | LOCUS77 | 3476: G > C Het | Het G > A | 18 | 1 |
| n/a | n/a | Wild-type | Wild-type | 16.4 | 5 |
| pWISE954 | LOCUS69 | 2505: C > T Homo | Silent Change | 18 | 5 |
| pWISE954 | LOCUS69 | 2505: C > T; 2507: C > T Homo | Homo A > V | 18 | 2 |
| pWISE954 | LOCUS69 | 2505: C > T; 2507: C > T, 2505: C > T Compound Het | Het A > V | 17.25 | 12 |
| pWISE954 | LOCUS69 | 2505: C > T; 2507: C > T; 2508: C > T, 2505: C > T; 2507: C > T Compound Het | Homo A > V | 17.43 | 7 |
| pWISE954 | LOCUS69 | 2505: C > T; 2507: C > T; 2508: C > T Homo | Homo A > V | 16 | 1 |
| pWISE954 | LOCUS69 | 2505: C > T; 2507: C > T; 2508: C > T, 2505: C > T Compound Het | Het A > V | 17 | 9 |

TABLE 4-continued

LRR-RLK Edits and KRN Phenotype Measurements

| Vector | Target Locus (SEQ ID No.) | Allele Locus Annotation | Allele Description | KRN Average | Sample Size |
|---|---|---|---|---|---|
| n/a | n/a | Wild-type | Wild-type | 17 | 2 |
| pWISE2711 | LOCUS69 | 2552: 12D Homo | Homo In-Frame | 20 | 1 |
| pWISE2711 | LOCUS69 | 2552: 12D, 2551: 10D Compound Het | Compound Het Stop / In-frame | 18 | 1 |
| n/a | n/a | Wild-type | Wild-type | 16.17 | 12 |
| pWISE2219 | LOCUS73 | 2582: C > T; 2586: C > T; 2588: C > T; 2590: C > T; 2591: C > T Het | Het LA > FV | 16.7 | 1 |
| pWISE2219 | LOCUS73 | 2588: C > T; 2590: C > T; 2591: C > T; 2597: C > T Het | Het A > V | 19 | 7 |
| n/a | n/a | Wild-type | Wild-type | 16.9 | 24 |
| pWISE2710 | LOCUS73 | 2987: 12D, 3001: 10D Compound Het | Compound Het Stop / In-Frame | 18 | 6 |
| pWISE2710 | LOCUS73 | 2992: 96D Homo | Homo In-Frame | 17.07 | 9 |
| pWISE2710 | LOCUS73 | 2994: 10D, 2996: 9D Compound Het | Compound Het Stop / In-Frame | 20 | 1 |
| pWISE2710 | LOCUS73 | 2995: 11D Homo | Homo Stop | 18 | 2 |
| pWISE2710 | LOCUS73 | 2995: 11D, 2996: 1I(N) Compound Het | Compound Het Stop / In-Frame | 16 | 1 |
| pWISE2710 | LOCUS73 | 2996: 15D, 2995: 11D Compound Het | Compound Het Stop / In-Frame | 17.67 | 6 |
| pWISE2710 | LOCUS73 | 2997: 10D Homo | Homo Stop | 18 | 1 |
| n/a | n/a | Wild-type | Wild-type | 16 | 17 |
| pWISE2713 | LOCUS70 | 2602: 15D Homo | Het In-Frame | 16.77 | 8 |
| pWISE2713 | LOCUS70 | 2602: 15D, 2603: 8D Compound Het | Compound Het Stop / In-Frame | 18 | 2 |
| pWISE2713 | LOCUS70 | 2602: 4D Het | Het Stop | 17.11 | 15 |
| pWISE2713 | LOCUS70 | 2602: 4D Homo | Homo Stop | 18 | 4 |
| pWISE2713 | LOCUS70 | 2602: 4D, 2601: 10D Compound Het | Homo Stop | 17 | 3 |
| pWISE2713 | LOCUS70 | 2603: 8D Het | Het Stop | 17 | 10 |
| n/a | n/a | Wild-type | Wild-type | 16.2 | 20 |

The foregoing is illustrative of the present invention and is not to be construed as limiting thereof. The invention is defined by the following claims, with equivalents of the claims to be included therein.

SEQUENCE LISTING (242 sequences)

SEQ ID NO: 1 - protein, 1228 aa, Lachnospiraceae sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3 - protein, 1241 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEDARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 4 - protein, 1238 aa, Candidatus Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDIVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIDRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLRPVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 5 - protein, 1281 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLDKIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 6 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKVNYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 7 - protein, 1206 aa, Lachnospiraceae sp.
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSVIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFDTQASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGLYLQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 8 - protein, 1233 aa, Lachnospiraceae sp.
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKKLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 9 - protein, 1227 aa, Lachnospiraceae sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIANINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIASNKEWLEYAQTSVKH

SEQ ID NO: 10 - protein, 1264 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYNKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNPLNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDISGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 11 - protein, 1373 aa, Moraxella bovoculi
MLFQDFTHLYPLSKTVRFELFIDRTLEHIHAKNFLSQDETMADMHQKVKVILDDYHRDFIADMMGEVKLTKLAEFYDVYLKFRKNPKDDELQKAQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFKDINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQKDFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIQASQAFFGKFDKICYNADKDYFEFHIDYAKFTDKAKNSRQIWTICSHGDKRYVYDKTANQNKGAAKGINVNDILKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 12 - protein, 1352 aa, Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITESKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKIKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 13 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 14 - protein, 1324 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIDALKGFYIEDGFENNVLTPLATLLSSLDKYNLNGIFIRNNEALSSLSQNVYRNFSIDEAIDAQNAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNKDDLNLSISSTEWLDFVREKPYLK

SEQ ID NO: 15 - protein, 1484 aa, Peregrinibacteria bacterium
  misc_feature (1073)..(1073): Xaa can be any naturally occurring amino acid
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAMIKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTWIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDXWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKK

SEQ ID NO: 16 - protein, 1245 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSISEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQHGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 17 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYQWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 18 - DNA, 3987 bp, Artificial sequence
  Synthetic polynucleotide
atggccgggagcaagaagcgccggataaagcaggacacgcagttcgagggcttcaccaacctgtaccaagtctccaagacgctccggttcgagcttatcccgcaagggaagaccctgaaacacatccaggaacaaggtttcatcgaggaggacaaggcccgcaacgaccactacaaggagctcaagcccataatcgatcggatctacaagacgtacgccgaccagtgcctccaactggtgcagctcgactgggagaacctgagcgccgccattgacagctaccgcaaggaaaagacggaggagacgcgcaacgcccttattgaggagcaagccacctaccgcaacgccatccacgactacttcatcgggcgcaccgacaacctgacggacgcgatcaacaagcgccacgcggaaatctacaagggccttttcaaggccgagctcttcaacgggaaggtcctaaaacagctcgggactgtcacgacaaccgagcatgagaacgccctccttcgcagcttcgacaagttcaccacatacttctcgggcttctaccggaaccgcaagaacgttttcagcgccgaggacatctccaccgccatcccgcacaggatcgtccaggacaacttccccaagttcaaggagaactgccacatcttcacgcgcctgattacagccgtaccttcacttcgtgagcacttcgagaacgtcaaaaaggccatcgggatcttcgtctccacgtccatcgaggaggtattctctttcccgttctataaccagctcctgacccagacgcagatcgacctctacaaccagctactgggcggcatcagccgggaggccgggaccgagaaaataaagggcctcaacgaagttctcaacctggccatccagaagaacgacgagaccgcgcatatcatcgcatccctgccgcatcgcttcattcctttgttcaagcagatattgagcgaccggaacaccctctcgttcatcctcgaagaattcaagagcgacgaggaggtcattcagtctttctgcaagtacaagacgctcctacggaatgagaatgtgctggagaccgcggaggcactcttcaatgagctgaactccattgacctgacccacatcttcattagccacaagaaactggagacgatctccagcgccctgtgcgaccactgggacactctccgcaacgccctctacgaacgccggatctccgaacttaccggcaagataactaagtcggctaaggagaaggtgcaacggagcctcaagcacgaggacatcaaccttcaggaaatcatctcagccgcgggcaaggagctgagcgaggcgtttaagcagaaaacatcggagatactgagccacgcgcacgcggccctggatcaaccgctgccgacgactctcaagaagcaagaggagaaggaaatccttaagtcccagctcgactcgctgctcggcctctatcacttgctcgactggttcgcggttgatgagtccaacgaggtggacccggagttctccgcgcgcctcacgggtattaagctggagatggagccaagcttaagcttctacaacaaggcccgcaactacgcgaccaaaaaaccgtactcagtcgagaaattcaagctgaatttccagatgcctacattggcgagggggtgggacgtgaaccgcgagaagaacaatggagccatcctgttcgtcaaaaatgggttgtactacctgggcatcatgcccaagcagaagggccgttacaaggccctgtcattcgagcctaccgagaagacctcggagggcttcgacaagatgtactacgactatttcccggacgccgccaagatgatcccgaagtgctccacgcagctcaaagccgtcacggcccacttccagacgcataccacgccgatacttctgagcaacaacttcattgagccgctagagatcacgaaggagatatacgacctaaacaaccccgaaaaggagcccaagaagttccagacagcctacgctaagaagacaggtgatcagaagggatatagggaggcactctgcaagtggatcgacttcacgcgcgacttcctgtcgaaatatacaaagacgaccagcattgacctaagttctctccgcccatcctcccagtacaaggatctgggcgagtattatgcggagctgaacccattgctgtaccacatcagcttccagaggatcgccgagaaggagattatggacgcggtggagacggggaaactatacctgttccaaatatataacaaggacttcgctaaagggcaccacgggaagcccaacctgcacacactctactggacgggcttgttttcgccagaaaatttggccaagacttcgatcaagctcaacggccaggcggagttgttttaccgtcccaagtctcgcatgaagcgcatggcgcatcgcctcggagagaaaatgcttaacaagaagctcaaggatcagaagacgcccatacctgatacgttgtaccaggaattgtacgactacgtgaaccaccgcctatcgcacgacctctcagacgaggcccgcgccctcctcccaaacgtgattactaaggaggtttcccatgaaataatcaaggaccgacggttcaccagcgacaaattttttttccacgtgcctatcacgctcaattaccaggcggccaactccccatcgaagttcaaccagcgcgtgaacgcctaccttaaggagcacccggagaccccaatcatcgggatcgaccgtggcgagcggaacctgatctatattacggtgatcgatagcaccgggaagatcctggagcagcgctccctgaacacaatccagcagtttgactaccagaagaaactcgacaaccgggagaaggagcgcgtcgcagcccggcaagcatggagtgtggtcggcaccataaaggacctgaaacagggttacctaagtcaagttatccacgagatcgttgacctgatgatacactatcaagccgtagtcgtgctggagaacctcaacttcgggtttaagtccaagcgcaccggcatcgcggagaaggcggtgtaccagcagttcgagaagatgctgatcgacaagctgaactgcctggtgctcaaggactaccctgcggagaaggtcggcggggtcttgaacccgtaccagctaaccgaccagttcacgagcttcgccaaaatgggcacgcagtccggattcttgttttatgtcccggctccatatacaagtaagatcgacccgctgacagggtttgttgacccattcgtgtggaagaccatcaagaaccacgagagcaggaaacacttcttagagggcttcgacttcctgcattacgacgttaagacaggcgacttcatcctgcacttcaagatgaaccgcaacctgtcgttccagaggggcctgcccggcttcatgcccgcctgggatatcgtctttgagaagaatgagacgcagttcgacgcgaaggggacgccgttcatcgctggaaagcggatcgtgccggtcatcgagaaccaccgcttcacgggtcgctaccgagatttataccccgccaacgaactaattgcgctgctggaggagaaggggatcgtgttccgagatggcagcaacattctcccgaagctgctggagaacgacgactcgcacgctattgacacgatggtcgccctcatacggagcgtgcttcagatgcggaacagtaacgctgccacgggcgaggactacattaactcccccgtccgcgacctcaacggggtctgcttcgatagccgcttccagaacccggagtggcctatggatgcggacgcgaacggggcctaccacatcgccctcaagggccaactcctgctcaaccacttgaaggaaagcaaagacctcaaattgcagaatggcatcagtaaccaggactggctcgcgtacatccaggaactgagaaacgggtccaagaagcggcgtatcaagcaagattga

SEQ ID NO: 19 - DNA, 3987 bp, Artificial sequence
  Synthetic polynucleotide
atggcgggaagcaaaaagcgccggattaagcaagacacgcagttcgagggcttcacgaacctctaccaagtcagcaagaccctccggttcgagctgataccacagggaaagacgctcaagcacatccaggaacagggcttcatcgaggaggacaaggcgcgcaacgaccactacaaggagttgaaaccgatcatcgaccgcatctacaagacgtacgccgaccagtgcctccagctcgtgcagctcgactgggagaacctctccgccgccattgactcgtaccggaaggagaagactgaggagacccgcaacgccctgatcgaggagcaagcaacctaccggaacgccatccacgactacttcatcggccgcaccgacaacctcaccgacgcgatcaacaagcggcacgcggagatatacaaagggctgttcaaggcggagctgttcaacggcaaggtgctcaagcagctagggacggtgaccacgaccgagcacgagaacgcgctcctccgcagcttcgacaagttcaccacctacttcagcggcttctaccggaaccgcaagaatgtgttcagcgcggaggacatcagcacggccatcccgcaccgcatcgtccaggacaacttcccgaagttcaaggagaactgccacatcttcacccgcctgataaccgccgtcccctccctgcgggagcacttcgagaacgtcaaaaaggcaattgggatcttcgtctcgaccagcattgaggaggtgttcagcttccccttctacaaccagctcctcacccagacgcagatcgacctgtacaatcagttgctcggcgggataagccgcgaggcgggaaccgaaaaaatcaaggggctgaacgaagtgttgaacctcgccatccagaagaacgacgagaccgcgcacatcatcgcctccctgccccaccggttcatcccgctgttcaagcagatcctctctgaccggaacaccctgtccttcattcttgaggagttcaagtcggacgaggaggtcatccagagcttctgcaagtacaagacgctgctacggaacgagaacgtgctggagacggcggaggcactgttcaacgagctaaacagcatcgacctcacgcacatcttcatcagtcacaagaaactggagaccatctcctccgcgctgtgcgaccactgggacacgctcaggaacgcgctctacgagcgccgaatcagtgagctgacgggcaagatcacgaagtccgcgaaggagaaggtgcagcggtccctcaagcacgaggacatcaacctccaggagatcatctcagcggctgggaaagagctgtccgaggcgttcaagcagaaaacgagcgaaatcctgtcccacgcgcacgcggccctggatcagcctctgccgacgaccctcaagaaacaagaagaaaaggaaatcctcaagtcgcagctcgactcgctgctgggcctgtaccatctcctcgactggttcgccgtggacgagagcaacgaggtggaccccgagttctccgcgcggcttacggggatcaagctggagatggagcccagcctgtccttctacaacaaggcgcgcaactacgccaccaagaagccctacagcgtggagaagttcaagctcaacttccagatgcccactctcgcacgtgggtgggacgtcaaccgcgaaaaaaataatggggcgatcctgttcgtcaagaacggcctgtactacttgggcatcatgccgaaacagaagggccgctacaaggccctgagcttcgaaccgaccgagaaaacgagcgaggggttcgacaagatgtactacgactacttccccgacgccgcgaagatgattccaaagtgctccacgcagcttaaggccgtgacggcccacttccagacgcacacgaccccgatcctcctcagcaacaacttcatcgagcccctggagatcacgaaggagatatacgacctgaacaacccggagaaggagcccaagaaattccagaccgcctacgccaagaagacaggcgaccaaaagggttacagggaggccctctgcaagtggatcgacttcactagggacttcctgtccaagtacaccaagactacctctatcgacctgtccagcctccgcccgtcgtcccagtacaaagatttgggcgagtattacgcggagctgaacccactgctctaccacatcagcttccagcgcatcgcggagaaggagatcatggacgcagtggagacgggcaagctatacctatttcagatatacaacaaagacttcgctaagggacaccacggcaagcctaacctgcacaccctctactggacggggctcttcagcccggagaacctcgccaagacctcgatcaagctcaacggccaggccgagctgttctaccggcccaagtcccgcatgaagcggatggcccaccggctcggggagaaaatgctcaacaagaaattgaaggaccaaaaaacgccgatacccgacaccctataccaggagctgtacgactatgtgaaccaccgcctgagccacgacctcagcgacgaggcgcgggccctcctgccgaacgtcatcacaaaggaggtcagccacgagatcatcaaggaccggcgcttcacctccgacaagtttttctttcacgtgcccatcacgctcaactaccaggccgccaactcgccgtccaagttcaaccagcgcgtgaacgcctacctcaaggagcaccccgagaccccgatcatcgggattgaccgaggggagcggaacctcatctacatcaccgtcatcgacagcaccgggaagatccttgaacagcggtcgctcaacaccatccagcagttcgactaccagaagaaactcgacaaccgggagaaggagagagtggcggcccgccaggcttggtccgtcgtcgggacgattaaggacttgaaacaaggttacctgtcgcaagtgatccacgagatcgttgacctgatgatccactaccaagccgtcgtggtcctggagaacctcaacttcggcttcaagagcaaacgaaccggcatcgcggagaaggccgtgtaccagcagttcgaaaaaatgctgatcgacaagctgaactgcctcgtgctcaaggactaccccgctgagaaggtcggcggggtgctgaacccgtaccagctcactgaccagttcaccagcttcgcaaagatgggcacccagtccggcttcctgttctacgtgcctgcgccatacacctcgaagatcgacccgctcaccgggttcgtggaccccttcgtctggaagaccatcaagaaccacgagagccgcaagcacttcctggagggcttcgacttcctccactacgacgtcaagaccggggacttcatcctgcacttcaagatgaaccgcaacctcagtttccagcgcggcctgccggggttcatgcccgcttgggatatagtcttcgagaagaatgagacgcagttcgacgcgaagggcaccccgttcatcgccgggaagcgcatcgtgccggtcatcgagaaccaccggttcaccgggcgctaccgcgacctatacccggcgaacgagttgatcgccctcctggaggagaagggcatcgtgttccgcgacggctccaacatcctcccgaagctgctcgaaaacgacgactcccacgccatcgacacgatggtcgcgctgatccggtcggtgctccagatgcggaactccaacgccgcgacgggcgaggactacatcaacagtccggtccgcgatctgaacggcgtctgcttcgactcccggttccagaaccccgagtggccgatggacgcggacgcgaacggcgcataccacatcgccctaaaagggcaattgctgctcaaccacctcaaggaatccaaagacctaaagctccagaacggcatctccaaccaggactggctggcgtacatccaggaactgcggaacgggagcaaaaaacgtcggatcaagcaagattga

SEQ ID NO: 20 - DNA, 3987 bp, Artificial sequence
  Synthetic polynucleotide
atggcgggctccaagaaacgccggattaagcaagatacccagttcgaggggttcacgaacctctaccaagtgagcaagaccctccgattcgaactgattcctcaggggaagaccctcaagcacatccaggagcaagggttcatcgaggaggacaaggcgcggaacgaccactacaaggaactcaaacccatcatcgaccgcatctacaagacctacgccgatcagtgcctccagctcgtgcagttggactgggagaacctcagcgcggccattgactcctaccggaaggagaaaacggaggagacgcgcaacgcgctcatcgaggaacaggcaacctatcgcaacgccatccacgactacttcatcgggaggactgacaacctcactgacgcgattaacaagcgccacgcggagatatacaagggactcttcaaagcggagctgtttaacggcaaggttctcaagcaactcggcactgtgaccacgaccgagcatgagaacgccctgctccgctccttcgacaagttcaccacctacttctccgggttctaccgcaaccgcaagaatgtcttcagcgcggaggacatcagcacggccattccacatcgaatcgtccaagataacttcccgaagttcaaggagaactgccacatcttcacccgactcattactgctgtaccgtcgttacgcgaacacttcgagaacgtcaagaaggcaattggaatcttcgtctctacgtcaatagaggaggtgttcagcttccctttctacaaccagctccttacgcagacccagatagacctgtacaatcagctcctcggtgggatcagccgggaggcggggactgagaagattaaagggctcaacgaggtcttgaacctggccatccaaaaaaacgatgagacggcgcacatcatcgcctcgctgccccaccggttcatcccgctgttcaagcagatcctcagtgacaggaacaccttgagctttatcctagaggagttcaagagcgacgaggaggtgatccagagcttctgcaagtacaaaaccctgctgaggaacgagaacgtcctggagacggcggaggcgctgttcaacgagctgaactctatcgacttaactcacatattcatctcgcacaagaagctggagactattagctctgcactctgcgaccactgggacaccctccgcaacgcgctctacgagcgccgcatctcggagctgaccgggaagatcaccaaatccgcgaaggaaaaggtccagcgttccctcaaacacgaggatattaacttacaggagattatctcagcggctgggaaggagttgtcagaggcgttcaagcagaaaacttccgagatcctgagccacgcgcacgcagcgctcgaccagcctctgcccaccaccctcaaaaagcaggaagaaaaagagatcctcaagagccagttggactccctgctggggctctatcaccttctcgactggttcgccgtcgatgagtcgaacgaggtggaccccgagttctccgcccggctgaccggcatcaagctagagatggagccgtccctcagcttctacaataaggcccgcaactacgcgaccaaaaaaccctacagcgtggagaagttcaagctgaacttccagatgccgaccttagcacgcggttgggacgtaaacagggagaagaacaatggagccatcctgttcgtcaagaacgggctttactacctcgggataatgcccaagcagaagggccgctacaaggccctttccttcgagccgacggagaaaacctccgaggggttcgacaagatgtactacgactacttccccgacgccgccaagatgatcccgaagtgctcaacgcagctaaaagccgtgaccgcccacttccagacccacacgacgccgatcctgctgagcaacaacttcatcgagccccttgagatcactaaggagatatacgacctgaacaaccccgagaaggagcccaagaagtttcaaaccgcctacgccaaaaaaactggcgaccaaaagggctacagggaggcgctgtgtaagtggatcgacttcacacgcgacttcctttcgaagtatacgaagacaacctctattgacctgagcagcctgcgtcctagctcccagtacaaagatttgggcgagtactacgcggagcttaatccactactctaccacatctcattccagcgcatcgctgagaaggaaatcatggacgcggtggagacaggcaaactgtacctcttccagatatacaacaaagacttcgctaaggggcaccacgggaagcccaaccttcatacgctctactggacgggcctattcagccccgaaaatctggccaagacctccatcaagctgaacggccaagcggagctgttctacagacccaagagccggatgaagcggatggcccacaggctcggcgagaaaatgcttaacaaaaagttgaaggaccagaaaacccctatccccgacaccctctaccaggaactgtacgactacgtgaaccacaggctctcgcacgacctttccgacgaggcccgtgccctactcccgaacgtcattaccaaagaggtttcgcacgagatcatcaaggaccggcggttcacgagcgacaagtttttctttcacgtccccatcacccttaactaccaggcggccaactccccatccaagttcaaccagcgtgtgaatgcctacctcaaggagcacccagagaccccgatcattgggatcgaccggggcgagcggaacctgatctacatcaccgtcatcgactcgacgggcaagattcttgagcagagatcgttgaataccatacagcagttcgactaccagaagaaactcgacaaccgcgagaaggagcgcgtggcggcccgccaggcgtggtccgtcgttgggacgattaaggacttgaaacaaggttatctgtcccaagtcatccacgagatcgttgatctgatgatccactatcaggcagtggtggtgctggagaatctcaacttcggcttcaagagtaagcggacgggaatcgccgagaaggccgtgtaccagcagttcgagaagatgctgatcgacaagctcaactgccttgtgctgaaagactacccggccgagaaggtcggcggcgtcctcaacccgtaccaacttaccgaccagttcacctccttcgccaagatgggcactcagtccgggttcttgttctacgtccccgcaccttacacctctaagatcgaccctctgactggcttcgtagatccattcgtgtggaagaccattaagaaccacgagagccgcaagcacttcctggagggcttcgacttcctgcactacgacgtgaagaccggggacttcatccttcacttcaagatgaaccggaacctcagcttccagcggggcctgccggggttcatgcccgcctgggacatcgtgttcgagaagaacgagacccagttcgacgcgaagggcacgcccttcatcgccgggaagcgtatcgtgccggtgatcgagaaccatcgtttcacgggtcgctaccgtgacctctacccggcgaacgagcttatcgcactcctggaggagaagggcatcgtcttccgggacggctccaacatcctcccgaaactgctggaaaacgacgactctcacgccatcgacacgatggtggccctcatccggtccgtgctccaaatgcggaacagcaacgccgccaccggtgaggactacatcaacagcccggtccgggatctgaacggggtgtgcttcgattcgcggttccagaatcctgagtggccgatggacgcggatgcaaacggggcgtaccacatcgcgctcaagggccagttacttctgaaccaccttaaggagtctaaagatttgaaactccagaacgggatctcgaaccaggactggctggcctacatccaagagttgcggaacggcagcaagaagcggcggattaagcaagattag

SEQ ID NO: 21 - DNA, 1592 bp, Medicago truncatula
actgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagg

SEQ ID NO: 22 - DNA, 2000 bp, Zea mays
gtcgtgcccctctctagagataaagagcattgcatgtctaaagtataaaaaattaccacatatttttttgtcacacttatttgaagtgtagtttatctatctctatacatatatttaaacttcactctacaaataatatagtctataatactaaaataatattagtgttttagaggatcatataaataaactgctagacatggtctaaaggataattgaatattttgacaatctacagttttatctttttagtgtgcatgtgatctctctgttttttttgcaaatagcttgacctatataatacttcatccattttattagtacatccatttaggatttagggttgatggtttctatagactaatttttagtacatccattttattctttttagtctctaaattttttaaaactaaaactctattttagttttttatttaataatttagatataaaatgaaataaaataaattgactacaaataaaacaaataccctttaagaaataaaaaaactaagcaaacatttttcttgtttcgagtagataatgacaggctgttcaacgccgtcgacgagtctaacggacaccaaccagcgaaccagcagcgtcgcgtcgggccaagcgaagcagacggcacggcatctctgtagctgcctctggacccctctcgagagttccgctccaccgttggacttgctccgctgtcggcatccagaaattgcgtggcggagcggcagacgtgaggcggcacggcaggcggcctcttcctcctctcacggcaccggcagctacgggggattcctttcccaccgctccttcgctttcccttcctcgcccgccgtaataaatagacaccccctccacaccctctttccccaacctcgtgttcgttcggagcgcacacacacgcaaccagatctcccccaaatccagccgtcggcacctccgcttcaaggtacgccgctcatcctccccccccccctctctctaccttctctagatcggcgatccggtccatggttagggcccggtagttctacttctgttcatgtttgtgttagagcaaacatgttcatgttcatgtttgtgatgatgtggtctggttgggcggtcgttctagatcggagtaggatactgtttcaagctacctggtggatttattaattttgtatctgtatgtgtgtgccatacatcttcatagttacgagtttaagatgatggatggaaatatcgatctaggataggtatacatgttgatgcgggttttactgatgcatatacagagatgctttttttctcgcttggttgtgatgatatggtctggttgggcggtcgttctagatcggagtagaatactgtttcaaactacctggtggatttattaaaggataaagggtcgttctagatcggagtagaatactgtttcaaactacctggtggatttattaaaggatctgtatgtatgtgcctacatcttcatagttacgagtttaagatgatggatggaaatatcgatctaggataggtatacatgttgatgcgggttttactgatgcatatacagagatgctttttttcgcttggttgtgatgatgtggtctggttgggcggtcgttctagatcggagtagaatactgtttcaaactacctggtggatttattaattttgtatctttatgtgtgtgccatacatcttcatagttacgagtttaagatgatggatggaaatattgatctaggataggtatacatgttgatgtgggttttactgatgcatatacatgatggcatatgcggcatctattcatatgctctaaccttgagtacctatctattataataaacaagtatgttttataattattttgatcttgatatacttggatgatggcatatgcagcagctatatgtggattttttagccctgccttcatacgctatttatttgcttggtactgtttcttttgtccgatgctcaccctgttgtttggtgatacttc

SEQ ID NO: 23 - protein, 228 aa, Rattus norvegicus
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 24 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 25 - DNA, 621 bp, Petromyzon marinus
acagatgcagagtatgtgagaattcacgaaaagctggacatctataccttcaagaagcagttctttaacaataagaagtctgtgagccataggtgctacgtgctgttcgagctgaagagaaggggtgaaagaagggcatgtttttgggggtatgctgtgaacaagccccagtctggaactgagagaggcattcacgccgaaattttcagcatcagaaaggtggaggaatacctgagggataaccctggacagtttacaattaattggtattctagctggtctccatgcgctgactgtgccgagaagatcctggaatggtacaaccaggagctgagaggaaatggccataccctgaagatttgggcctgcaagctgtactatgaaaagaacgcaagaaatcagatcggactgtggaacctgagggataatggtgtggggctgaacgtgatggtgtccgagcactatcagtgctgtagaaagattttcattcagtcctcacataatcagctgaacgagaatagatggctggaaaagactctgaagagggctgagaagagaaggtccgaactgtcaattatgatccaggtgaagatcctgcacaccactaagtcacctgccgtg

SEQ ID NO: 26 - protein, 160 aa, Artificial sequence
  Synthetic polypeptide
FERNYDPRELRKETYLLYEIKWGKSGKLWRHWCQNNRTQHAEVYFLENIFNARRFNPSTHCSITWYLSWSPCAECSQKIVDFLKEHPNVLEIYVARLYYHEDERNRQGLRDLVNSGVTIRIMDLPDYNYCWKTFVSDQGGDEDYWPGHFAPWIKQYSLKL

SEQ ID NO: 27 - protein, 207 aa, Artificial sequence
  Synthetic polypeptide
TDAEYVRIHEKLDIYTFKKQFSNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWVCKLYYEKNARNQIGLWNLRDNGVGLNVMVSEHYQCCRKIFIQSSHNQLNENRWLEKTLKRAEKRRSELSIMFQVKILHTTKSPAV

SEQ ID NO: 28 - protein, 228 aa, Artificial sequence
  Synthetic polypeptide
SSKTGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPNVTLFIYIARLYHLANPRNRQGLRDLISSGVTIQIMTEQESGYCWHNFVNYSPSNESHWPRYPHLWVRLYVLELYCIILGLPPCLNILRRKQSQLTSFTIALQSCHYQRLPPHILWATGLK

SEQ ID NO: 29 - protein, 162 aa, Artificial sequence
  Synthetic polypeptide
SFERNYDPRELRKETYLLYEIKWGKSGKLWRHWCQNNRTQHAEVYFLENIFNARRFNPSTHCSITWYLSWSPCAECSQKIVDFLKEHPNVNLEIYVARLYYPENERNRQGLRDLVNSGVTIRIMDLPDYNYCWKTFVSDQGGDEDYWPGHFAPWIKQYSLKL

SEQ ID NO: 30 - protein, 166 aa, Escherichia coli
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 31 - protein, 166 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 32 - protein, 166 aa, Artificial sequence
  Synthetic polypeptide
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 33 - protein, 166 aa, Artificial sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 34 - protein, 166 aa, Artificial sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTD

SEQ ID NO: 35 - protein, 1763 aa, Artificial sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1565 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 1565 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 364 aa, Artificial sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 39 - protein, 167 aa, Artificial sequence
  Synthetic polypeptide
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTD

SEQ ID NO: 40 - protein, 167 aa, Artificial sequence
  Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSIN

SEQ ID NO: 41 - protein, 83 aa, Bacillus phage AR9
TNLSDIIEKETGKQLVIQESILMLPEEVEEVIGNKPESDILVHTAYDESTDENVMLLTSDAPEYKPWALVIQDSNGENKIKML

SEQ ID NO: 42 - RNA, 19 nt, Artificial sequence
  Synthetic oligonucleotide
  misc_feature (1)..(19): n is a, c, g, or u
nnnnnnnnnnnnnnnnnnn

SEQ ID NO: 43 - DNA, 22 bp, Artificial sequence
  Synthetic oligonucleotide
  misc_feature (4)..(22): n is a, c, g, or t
aaannnnnnnnnnnnnnnnnnn

SEQ ID NO: 44 - DNA, 22 bp, Artificial sequence
  Synthetic oligonucleotide
  misc_feature (4)..(22): n is a, c, g, or t
tttnnnnnnnnnnnnnnnnnnn

SEQ ID NO: 45 - protein, 24 aa, Artificial sequence
  Synthetic peptide
EELLSKNYHLENEVARLKKGSGSG

SEQ ID NO: 46 - protein, 241 aa, Artificial sequence
  Synthetic polypeptide
EEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 47 - protein, 277 aa, Artificial sequence
  Synthetic polypeptide
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGS

SEQ ID NO: 48 - DNA, 66 bp, Saccharomyces bayanus
ttcttgtcgtacttatagatcgctacgttatttcaattttgaaaatctgagtcctgggagtgcgga

SEQ ID NO: 49 - protein, 605 aa, Homo sapiens
MSGWESYYKTEGDEEAEEEQEENLEASGDYKYSGRDSLIFLVDASKAMFESQSEDELTPFDMSIQCIQSVYISKIISSDRDLLAWFYGTEKDKNSVNFKIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPLKEACRAYGLKSGLKKQELLEALTKHFQD

SEQ ID NO: 50 - protein, 482 aa, Artificial sequence
  Synthetic polypeptide
MVRSGNKAAWLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISERHSIHWPCRLTIGSNLSIRIAAYKSILQERVKKTTWDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDIWAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAK

SEQ ID NO: 51 - DNA, 10 bp, Methanobacterium thermoautotrophicum
aatttttgga

SEQ ID NO: 52 - protein, 83 aa, Methanobacterium thermoautotrophicum
GSVIDVSSQRVNVQRPLDALGNSLNSPVIIKLKGDREFRGVLKSFDLHMNLVLNDAEELEDGEVTRRLGTVLIRGDNIVYISP

SEQ ID NO: 53 - DNA, 25 bp, Bacteriophage MS2
gcgcacatgaggatcacccatgtgc

SEQ ID NO: 54 - protein, 116 aa, Bacteriophage MS2
MASNFTQFVLVDNGGTGDVTVAPSNFANGIAEISSNSRSQAYKVTCSVRQSSAQNRKYTIKVEVPKGAWRSYLNMELTIPIFATNSDCELIVKAMQGLLKDGNPIPSAIAANSGIY

SEQ ID NO: 55 - DNA, 26 bp, Bacteriophage PP7
ataaggagtttatatggaaaccctta

SEQ ID NO: 56 - protein, 127 aa, Bacteriophage PP7
MSKTIVLSVGEATRTLTEIQSTADRQIFEEKVGPLVGRLRLTASLRQNGAKTAYRVNLKLDQADWDCSTSVCGELPKVRYTQVWSHDVTIVANSTEASRKSLYDLTKSLVATSQVEDLVVNLVPLGR

SEQ ID NO: 57 - DNA, 19 bp, Shigella phage
ctgaatgcctgcgagcatc

SEQ ID NO: 58 - protein, 62 aa, Shigella phage
MKSIRCKNCNKLLFKADSFDHIEIRCPRCKRHIIMLNACEHPTEKHCGKREKITHSDETVRY

SEQ ID NO: 59 - protein, 1367 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 60 - protein, 1367 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 61 - DNA, 4101 bp, Artificial sequence
  Synthetic polynucleotide
gacaagaagtacagcatcgggctggcgatcgggaccaactccgtcggctgggctgtgattaccgacgagtacaaggtgccatccaagaagttcaaggtcctcggcaacactgaccggcacagcattaagaagaacctgattggggcgctgctgttcgattcgggggagactgcggaggcgaccaggctgaagcggactgcgcgccggaggtacaccaggaggaagaatcggatctgctacctccaggagattttctcgaatgagatggccaaggtggacgattccttcttccatcgcctggaggagtcgttcctcgttgaggaggacaagaagcatgagaggcatcccattttcgggaatatcgttgacgaggtggcttaccatgagaagtacccgaccatctaccatctgcggaagaagctcgtcgattcgaccgataaggccgacctgcggctgatctacctggccctcgcgcacatgattaagttccggggccatttcctcatcgagggcgacctcaacccggacaactcggacgtggataagctcttcattcagctcgtgcagacatacaaccagctcttcgaggagaatcccattaacgcctcgggggtcgacgctaaggctattctctcggctcggctgtcgaagtcgcgccggctggagaatctcattgcccagctcccaggcgagaagaagaacggcctcttcggcaacctgattgccctgtcgctggggctcacaccgaatttcaagtcgaacttcgacctcgccgaggacgctaagctccagctcagcaaggatacttacgatgatgacctcgataacctgctcgcccagattggggatcagtacgcggatctgttcctcgcggccaagaatctcagcgatgctattctcctgtcggacattctccgcgtcaacacagagattactaaggccccactgtcggcgagcatgattaagaggtacgatgagcatcatcaggacctgacactgctcaaggcgctggtccggcagcagctccccgagaagtacaaggagattttcttcgatcagtcaaagaatgggtacgcgggctacattgatggcggcgcgtcccaggaggagttctacaagttcattaagcccatcctggagaagatggacgggaccgaggagctgctggtgaagctcaatcgggaggacctgctccggaagcagcgcacattcgacaatggctcgattcctcaccagattcacctgggcgagctgcacgccattctccgcaggcaggaggacttctacccgttcctcaaggacaaccgcgagaagatcgagaagatcctgaccttccggattccatactacgtggggccgctcgcgcgggggaactcccggttcgcgtggatgactcgcaagtccgaagaaacgattacaccgtggaatttcgaggaggtcgtcgacaagggcgctagtgcgcagtcattcattgagaggatgaccaatttcgataagaacctgcctaacgagaaggtgctgccgaagcattcgctgctctacgagtacttcaccgtttacaatgagctgaccaaggtgaagtatgtgactgagggcatgaggaagccagcgttcctgagcggcgagcagaagaaggctatcgtggacctgctcttcaagactaaccggaaggtgactgtgaagcagctcaaggaggactacttcaagaagattgagtgcttcgattccgttgagattagcggggtggaggatcggttcaatgcttcgctcgggacataccacgatctcctgaagatcattaaggataaggacttcctcgacaacgaggagaacgaggacattctcgaagatattgtcctgaccctcaccctcttcgaggatcgggagatgatcgaggagaggctcaagacatacgctcatctgttcgatgataaggtcatgaagcagctgaagcgcaggcggtacacagggtgggggcggctgagccggaagctgatcaacgggattcgggataagcagtccgggaagacaattctcgacttcctcaagtccgacgggttcgctaaccggaacttcatgcagctcattcatgatgactcgctgacattcaaggaggatattcagaaggcgcaggtttcggggcagggcgactcgctccacgagcatattgcgaatctggcgggctcccccgcgattaagaagggcattctgcaaaccgtcaaggtggttgatgagctggtcaaggtcatggggcggcataagccagagaatattgtcatcgagatggcgcgggagaatcagaccacacagaaggggcagaagaactcacgggagcggatgaagcgcatcgaggagggcatcaaggagctggggtcgcagatcctgaaggagcatcccgtggagaacactcagctgcaaaatgagaagctgtacctctactacctccagaacgggagggacatgtatgtggatcaggagctggatattaataggctgagcgattacgatgtcgaccacattgtcccacagtcgttcctgaaggacgacagcattgacaacaaggtgctgacccgctcggataagaacaggggcaagagcgataatgttccaagcgaggaggttgtgaagaagatgaagaactactggcggcagctcctgaacgcgaagctcatcacacagcggaagttcgacaacctcaccaaggctgagcgcgggggcctgagcgagctggacaaggcggggttcattaagaggcagctggtcgagacacggcagattacaaagcatgttgcgcagattctcgattcccggatgaacaccaagtacgatgagaacgataagctgattcgggaggtcaaggtaattaccctgaagtccaagctggtgtccgacttcaggaaggacttccagttctacaaggttcgggagatcaacaactaccaccacgcgcatgatgcctacctcaacgcggtcgtggggaccgctctcatcaagaagtacccaaagctggagtcagagttcgtctacggggattacaaggtttacgacgtgcggaagatgatcgctaagagcgagcaggagattggcaaggctaccgctaagtacttcttctactccaacatcatgaacttcttcaagacagagattaccctcgcgaatggcgagatccggaagaggcccctcatcgagacaaatggggagacaggggagattgtctgggataaggggcgggatttcgcgaccgtccggaaggtcctgtcgatgccccaggttaatattgtcaagaagactgaggtccagactggcggcttctcaaaggagtcgattctcccaaagaggaactccgataagctcattgctcggaagaaggattgggaccccaagaagtacgggggattcgactcccccactgttgcttactctgttctggttgttgctaaggtggagaaggggaagtcgaagaagctgaagagcgtgaaggagctgctcgggattacaattatggagaggtcatccttcgagaagaatcccatcgacttcctggaggccaagggctacaaggaggtgaagaaggacctgattattaagctgcccaagtactcgctcttcgagctggagaatgggcggaagcggatgctggcgtccgcgggggagctgcaaaaggggaacgagctggcgctcccctccaagtatgtgaacttcctctacctggcgtcgcactacgagaagctgaaggggtccccagaggataatgagcagaagcagctcttcgtcgagcagcataagcactacctggacgagattatcgagcagattagcgagttctcgaagcgggtcatcctcgcggatgcgaacctggataaggtgctcagcgcctacaataagcaccgggacaagccgattcgggagcaggcggagaatattattcacctcttcacactcaccaacctcggggcaccagctgcgttcaagtacttcgacactactatcgaccggaagcggtacacctcgacgaaggaggtgctcgacgccaccctcattcaccagtcgatcacaggcctgtacgagacacggattgacctgtcccagctcgggggcgac

SEQ ID NO: 62 - DNA, 4101 bp, Artificial sequence
  Synthetic polynucleotide
gacaagaagtactccattggcctggcgattgggacaaactcggtggggtgggccgtgattacggatgagtacaaggttccaagcaagaagttcaaggtcctcgggaacacagatcggcattcgattaagaagaatctcattggggcgctcctcttcgactcgggggagacagcggaggctaccaggctcaagcggacagccaggcggcggtacacaaggcggaagaatcgcatctgctacctccaggagattttctcgaatgagatggcgaaggtggacgacagcttcttccatcggctggaggagtccttcctggtggaggaggataagaagcacgagaggcatccaattttcgggaacatcgtggacgaggttgcgtaccatgagaagtaccctacaatctaccatctgcggaagaagctggttgactccacagacaaggcggacctgaggctgatctacctcgctctggcccacatgattaagttccgcgggcatttcctgatcgagggggacctgaatcccgacaattcggatgtggacaagctcttcatccagctggtgcagacctacaaccagctgttcgaggagaatcccatcaatgcgtcgggcgttgacgctaaggccattctgtccgctaggctgtcgaagagcaggaggctggagaacctgatcgcccagctgccaggcgagaagaagaatgggctcttcgggaatctgattgcgctctccctggggctgacaccgaacttcaagagcaatttcgatctggctgaggacgcgaagctccagctctcgaaggacacttacgacgatgacctcgataacctcctcgcgcagatcggggaccagtacgctgatctcttcctcgccgctaagaacctctcggatgctatcctgctctccgacattctccgggttaataccgagattacaaaggccccactgtcggcgtccatgatcaagcggtacgatgagcatcatcaggatctcaccctgctcaaggccctcgtgcggcagcagctgcccgagaagtacaaggagattttcttcgaccagagcaagaatgggtacgctggctacattgacggcggggcctcacaggaggagttctacaagttcatcaagccaatcctggagaagatggatgggacagaggagctgctggtgaagctcaaccgggaggatctgctcaggaagcagcggacgttcgacaacgggtcgattccccatcagatccacctgggggagctgcacgcgatcctgcgccggcaggaggatttctaccctttcctgaaggataatcgggagaagatcgagaagattctcaccttccggattccctactacgtcgggccactcgcgcggggcaatagcaggttcgcctggatgacacggaagagcgaggagacaatcaccccctggaacttcgaggaggttgtcgacaagggggcgtccgcccagtcattcattgagcggatgaccaatttcgacaagaatctgccaaatgagaaggttctcccaaagcatagcctcctctacgagtacttcactgtttacaacgagctgaccaaggtgaagtatgtgaccgagggcatgcggaagcccgcgttcctgtccggcgagcagaagaaggccattgtggacctcctgttcaagaccaatcgcaaggtcacagtcaagcagctcaaggaggattacttcaagaagatcgagtgcttcgactcggttgagattagcggggtggaggatcggttcaacgcgagcctcggcacttaccacgacctcctgaagatcatcaaggataaggacttcctcgacaacgaggagaacgaggatattctggaggacatcgtgctcaccctgacgctgttcgaggatcgggagatgatcgaggagcgcctgaagacctacgctcatctcttcgatgataaggtcatgaagcagctgaagaggaggcggtacaccgggtggggccgcctgagcaggaagctcattaacgggatcagggacaagcagagcggcaagaccatcctggacttcctcaagagcgatggcttcgccaaccggaatttcatgcagctcatccacgacgactccctcaccttcaaggaggacattcagaaggctcaggtcagcggccagggcgactcgctgcatgagcacatcgctaacctggcgggcagcccagccatcaagaagggcatcctccagacagtgaaggtcgtggatgagctggtgaaggtcatgggccggcataagcccgagaatattgtgattgagatggcgcgggagaatcagaccactcagaagggccagaagaactcgcgggagcgcatgaagaggatcgaggaggggattaaggagctgggcagccagattctcaaggagcaccccgtggagaatacccagctccagaacgagaagctgtacctctactacctccagaatgggcgggacatgtatgttgatcaggagctggacatcaatcgcctctcggattacgacgtggaccacatcgtgccccagagcttcctgaaggatgatagcatcgacaataaggtcctgacccgctccgacaagaatcgcggcaagagcgacaacgtgccgagcgaggaggtcgtgaagaagatgaagaactactggcggcagctgctgaacgcgaagctcattacacagcggaagttcgataacctgacgaaggcggagaggggcggcctctccgagctggacaaggcgggcttcattaagaggcagctcgtggagactcgccagatcaccaagcacgtggctcagatcctcgatagccggatgaatacgaagtacgatgagaatgacaagctcatccgggaggtgaaggtaatcaccctgaagtcaaagctcgttagcgatttccggaaggacttccagttctacaaggtgcgggagattaacaactaccatcatgcgcacgatgcgtacctcaatgcggtggtgggcacagccctgattaagaagtaccccaagctggagagcgagttcgtctacggggactacaaggtgtacgatgttcggaagatgatcgccaagagcgagcaggagattgggaaggccaccgctaagtacttcttctactcgaatattatgaatttcttcaagaccgagatcacactcgctaatggggagattcggaagcggcccctcatcgagactaacggggagactggcgagattgtgtgggacaaggggcgcgacttcgctaccgtgcgcaaggtcctctcgatgccccaggttaatattgttaagaagacagaggtgcagacgggcgggttctccaaggagtctatcctgccgaagcggaactcggacaagctgatcgcccgcaagaaggattgggaccccaagaagtacgggggattcgatagcccaaccgtggcttacagcgtcctggtggtcgccaaggttgagaaggggaagtcgaagaagctcaagagcgttaaggagctgctgggcatcaccatcatggagcggtccagcttcgagaagaatcctatcgacttcctggaggctaaggggtacaaggaggtcaagaaggacctgatcattaagctgcccaagtactctctgttcgagctggagaacgggaggaagcggatgctggcgtctgctggcgagctacagaagggcaatgagctggcgctcccctcgaagtatgtcaacttcctctacctggcttcccattacgagaagctgaagggctcgcccgaggataatgagcagaagcagctcttcgtggagcagcacaagcactacctcgacgagatcattgagcagatttcggagttctcgaagcgggtcattctcgcggacgcgaacctcgacaaggtcctctcggcgtacaacaagcaccgggacaagcccatccgggagcaggccgagaacattatccacctcttcacactgaccaacctcggcgctcccgccgcgttcaagtacttcgacaccaccattgaccgcaagagatacacatccaccaaggaggtgctggacgcgaccctcatccaccagagcatcacaggcctctacgagacacggatcgacctctcgcagctcgggggcgat

SEQ ID NO: 63 - DNA, 4092 bp, Artificial sequence
  Synthetic polynucleotide
gacaagaagtactcgatcggcctggcgattggcacaaacagcgtggggtgggctgtgatcactgatgagtacaaggtgccatcgaagaagttcaaggtgctggggaatacagaccggcattcgatcaagaagaatctcattggcgctctcctcttcgattccggcgagactgctgaggcgacccgcctgaagcgcaccgcccggcggcgctacactcggcggaagaataggatttgctacctccaggagattttctcgaatgagatggccaaggtggatgacagcttcttccaccgcctggaggagtcgttcctggtcgaggaggacaagaagcatgagcggcaccctatcttcgggaatatcgttgatgaggtcgcctaccacgagaagtaccccactatctaccatctccgcaagaagctcgtggacagcacagataaggccgacctccgcctgatctacctcgccctcgcgcacatgattaagttccgggggcacttcctcattgagggggatctgaatcccgataactccgacgtggacaagctgttcatccagctggtgcagacatacaaccagctgttcgaggagaatcccatcaacgcgagcggcgtggacgctaaggccattctgtcggctaggctctcgaagtcgaggcggctggagaacctgattgcgcagctccccggcgagaagaagaacgggctgttcgggaatctcatcgccctctccctcggcctcacaccaaacttcaagagcaatttcgacctggctgaggacgctaagctgcaactctcaaaggatacatacgatgacgacctggacaatctcctggctcagatcggcgaccagtacgctgacctgttcctcgcggccaagaatctgtcggacgcgattctcctcagcgacatcctgcgcgtcaataccgagattacgaaggctccactgtctgcgtcaatgattaagcggtacgatgagcatcaccaggatctgaccctcctgaaggcgctcgtgcggcagcagctgcccgagaagtacaaggagattttcttcgatcagagcaagaatggctacgccggctacatcgacgggggcgcgagccaggaggagttctacaagttcatcaagcccatcctggagaagatggacggcaccgaggagctactcgtgaagctcaatcgggaggatctcctccggaagcagcggacattcgataacgggtctatcccacaccagatccacctcggcgagctgcatgcgattctgcggcggcaggaggatttctaccctttcctgaaggacaaccgggagaagatcgagaagatcctcacattccggattccatactacgtcggccccctggcgaggggcaatagccggttcgcgtggatgacaaggaagtccgaggagactattaccccgtggaatttcgaggaggtggttgacaagggcgcttccgcgcagagcttcattgagcggatgacaaacttcgacaagaatctccccaacgagaaggtcctgccgaagcatagcctcctgtacgagtacttcaccgtctacaatgagctaactaaggtcaagtatgtgacagagggcatgaggaagccagccttcctctcaggcgagcagaagaaggccattgtggacctcctgttcaagacaaaccgcaaggtgacagtgaagcagctgaaggaggattacttcaagaagattgagtgcttcgactcagtggagatttcaggcgtggaggatcggttcaacgcgagcctggggacttaccacgacctgctgaagattattaaggacaaggacttcctggataacgaggagaatgaggacatcctggaggatattgtgctcaccctcaccctgttcgaggacagggagatgattgaggagaggctcaagacctacgcgcacctgttcgatgacaaggtcatgaagcagctgaagaggcggcgctacactgggtggggccgcctgtcgcggaagctgatcaacggcattcgggataagcagtccgggaagaccattctggatttcctgaagtcggacggcttcgccaacaggaatttcatgcagctgatccacgacgactccctcaccttcaaggaggacattcagaaggcccaggttagcggccagggggactcactccacgagcatattgccaatctggccggctctccagctatcaagaagggcatcctgcaaacagttaaggttgttgacgagctggttaaggtcatggggcggcataagcccgagaacattgtcatcgagatggctcgggagaaccagacaactcagaagggccagaagaactccagggagcgcatgaagcggattgaggagggcattaaggagctggggtcccagatcctcaaggagcaccctgtcgagaacactcagctgcaaaacgagaagctctacctgtactacctccagaacgggcgggatatgtatgtggatcaggagctggacatcaacaggctctccgactacgacgtggatcacattgtcccacagtctttcctcaaggatgattccatcgacaacaaggtgctgacgcgcagcgacaagaatagggggaagtcggacaacgttccgagcgaggaggtcgtgaagaagatgaagaattactggaggcagctcctgaatgcgaagctgatcactcagaggaagttcgacaatctgacaaaggcggagaggggcgggctctcggagctggataaggcgggcttcatcaagcggcagctcgttgaaacccggcagatcaccaagcatgtcgcccagatcctcgatagccgcatgaacaccaagtacgatgagaacgacaagctcattcgggaggttaaggtcattacgctgaagtccaagctcgtcagcgacttcaggaaggatttccagttctacaaggttcgggagattaacaactaccaccacgcgcatgatgcgtacctgaacgctgttgtcggcactgctctcatcaagaagtacccaaagctggagtccgagttcgtctacggggactacaaggtctacgatgtccggaagatgatcgccaagtcggagcaggagatcgggaaggctactgcgaagtacttcttctacagcaacattatgaatttcttcaagacggagattacgctggcgaacggggagattaggaagaggcccctcattgagactaatggggagacaggcgagattgtttgggacaagggccgcgacttcgcgactgtgcggaaggtcctgtccatgccacaggtgaatattgttaagaagacagaggtgcagactgggggcttctcgaaggagagcattctcccaaagcggaacagcgataagctcatcgcgcgcaagaaggattgggaccctaagaagtacggcggcttcgattctcccactgtggcctactccgttctcgtggttgccaaggttgagaaggggaagtcgaagaagctgaagtcggtcaaggagctgctcgggattacaatcatggagcggagcagcttcgagaagaaccctattgatttcctggaggccaagggctacaaggaggttaagaaggatctcattatcaagctccctaagtactctctgttcgagctggagaatggccggaagaggatgctggcctcggctggcgagctacagaaggggaatgagctggccctcccgtcgaagtatgtgaatttcctgtacctcgcgtcgcactacgagaagctcaagggcagcccggaggataatgagcagaagcagctcttcgtggagcagcataagcactacctggacgagatcattgagcagatcagcgagttctcgaagcgggttattctggctgatgctaacctggacaaggttctgagcgcctacaataagcatcgcgacaagccgattcgcgagcaggcggagaatattatccacctgttcaccctcactaacctcggggctcccgcggccttcaagtacttcgataccacaatagataggaagcggtacacctcgacgaaggaggtcctcgacgccacactcatccatcagtcgattacaggcctgtacgagacacggattgacctctcgcagctg

SEQ ID NO: 64 - DNA, 4101 bp, Artificial sequence
  Synthetic polynucleotide
gacaagaagtattccataggcctggctatcggcaccaacagcgtgggctgggccgtcatcaccgacgagtacaaagtgccgagtaaaaagttcaaagtgctcggcaacaccgaccgccactccataaagaaaaacctgatcggggcgctcctgttcgacagcggcgagacggcggaggccacccgcttgaaacgcacggcccgacggcgctacacgcggcgcaagaaccggatctgttacctacaggagattttctctaacgagatggcgaaggtggacgactcgttctttcaccgcctcgaagagtccttcctcgtggaggaggacaagaaacacgagcgccacccgatcttcggcaacatcgtggacgaggtggcctaccacgagaagtacccgaccatctaccacctccggaagaaactcgtggacagcacggacaaggccgacctgaggctcatctacctcgccctggcgcacatgattaagttccggggccacttcctgatcgagggcgacctgaacccggacaacagcgacgtggacaagctgttcatccagctagtccagacctacaaccagcttttcgaggaaaaccccatcaacgccagcggggtggacgcgaaggcgatcctgtccgcccggctgagcaagtcccggcggctggagaacctcatcgcgcagttgcccggcgagaagaagaacgggctgttcgggaacctgatcgccctctccctggggctcaccccgaacttcaagtccaacttcgacctcgccgaggacgccaaactacagctgagcaaggacacctacgacgacgacctcgacaacctgctggcccagatcggggaccagtacgcagacctgttcctcgccgccaagaacctctccgacgccatcctgctgtcggacatcctgcgggtgaacacggagatcacgaaggccccgctctcggcctcgatgattaaacgctacgacgagcaccaccaggacttgaccctcctcaaggcgctggtccgccagcagcttcccgagaagtacaaggaaatctttttcgatcagagcaagaacgggtacgccgggtacatcgacggcggggcgtcccaggaggagttctacaagttcatcaagcccatcctggagaaaatggacgggaccgaggagctgctcgtgaagctcaaccgcgaagatttgctccgcaagcagcgcacgttcgacaacgggtcgatcccgcaccagatccacctgggcgagctgcacgcgatcctcaggcgtcaggaagacttctaccccttcctcaaggacaaccgcgagaagatagagaagattctgaccttcagaattccttattacgtgggcccgctggctcggggcaactcgcgcttcgcctggatgacgcgcaagtccgaggagaccatcaccccgtggaacttcgaggaggtggtggataagggtgcctcggcccagtccttcatcgagcggatgaccaacttcgacaagaacctgccgaacgagaaggtgctccccaagcacagcctgctctacgaatatttcacggtgtacaacgagctgacgaaggtcaagtacgtgaccgagggaatgaggaaacctgcattcctctccggggagcagaagaaagccatagtcgacctcctgttcaagaccaaccggaaggtcaccgtcaagcagctcaaggaggactacttcaagaagatcgagtgcttcgattcagtggagatcagcggcgtcgaggaccggttcaacgccagcctgggcacctaccacgacctgctcaagatcatcaaggacaaggacttcctcgacaacgaggagaacgaggacatcctggaggacatcgtgctgaccctgacgctcttcgaggaccgcgagatgatcgaggagcgcctcaagacctacgcccacctgttcgacgacaaggtgatgaagcagctcaagcggcggagatatactgggtggggccgcctctcccggaagctcattaacggtatcagggataagcagtccgggaagacgatcctcgacttcctcaagtcggacgggttcgccaaccgcaacttcatgcagctcatccacgacgactccctgacgttcaaggaggacatccagaaggcccaagtgtctggtcaaggtgactcgctccacgagcacatcgccaacctcgcgggcagcccggccatcaagaagggaatactccagaccgtcaaggtggtggacgagctggtgaaggtcatgggccgccacaagccggagaacatcgtcatcgagatggcgcgggagaaccagaccacgcagaaggggcagaaaaatagccgtgagcgcatgaagcgcatcgaggaggggattaaggagttgggcagccagatcctcaaggagcaccctgtggagaacacgcagttgcaaaacgagaagctctacctgtactacctccagaacgggagggatatgtacgtggaccaagaactggacatcaaccgcctgtccgactacgacgtggaccacatcgtgccgcagagcttcctcaaggacgacagcatcgacaacaaggtgctcacccggtccgacaagaatcggggcaagtccgacaacgtgcccagcgaggaggtcgtcaaaaagatgaaaaactactggcgacaactactgaacgccaagctcatcacccagcgcaagttcgacaacctcacaaaagccgagcgcggcgggttgagcgagctggacaaggccgggttcatcaagcgccagctcgtcgagacgcgccagatcacgaagcacgtcgcgcagatactcgacagccggatgaacaccaagtacgacgagaacgacaagctcatccgggaggtgaaggtcatcaccctcaagtcgaagctcgtgagcgacttccgcaaggacttccagttctacaaggtccgggagatcaacaactaccaccacgcccacgatgcttatcttaacgccgtggtggggacggccctcattaagaaatacccgaagctggagtcggagttcgtgtacggcgactacaaggtgtacgacgtcaggaagatgatcgccaagtccgaacaggagatcgggaaggccacggcgaaatacttcttctacagcaacatcatgaacttcttcaagaccgagatcaccctcgccaacggcgagatccgcaagcgcccgctcatcgagacgaacggggagaccggcgagatcgtctgggacaaggggcgcgacttcgccactgtgcggaaggtgctgtcgatgccccaggtcaacatcgtcaagaagacggaggtccagacgggcgggttcagcaaggagagcatcctgccgaagcgcaacagcgacaagctgatcgcccgcaaaaaggactgggatccaaaaaagtacggcggcttcgacagccccaccgtcgcctacagcgtcctcgtcgtcgctaaagtcgagaagggcaagtccaaaaagctcaagagcgtcaaggagctgctcgggatcaccatcatggagcggtccagcttcgagaagaacccaattgatttcctggaggcgaagggctacaaggaggtcaagaaagacctcatcataaagctgccgaagtactcactcttcgagctggagaacgggcgcaagcggatgctggcgtcggccggagagctccaaaagggcaacgagctggcgctgccgagcaagtacgtgaacttcctctacctggcgtcccactacgagaagctcaagggcagtccagaggataacgagcagaagcagctattcgtggagcagcacaagcactacctggacgagatcatcgagcagatcagcgagttctccaagcgcgtcatcctggcggacgccaacctggacaaggtgctgtccgcgtacaacaagcaccgcgacaagccgatccgcgagcaagccgagaacatcatccacctgttcaccctcacgaacctcggggcacccgccgccttcaaatatttcgacacgaccatcgaccgcaagcgctacaccagcacgaaggaggtgctcgacgccaccctgatccaccagagcatcaccgggctgtacgagacccgcatcgacctctcgcagctcggcggggac

SEQ ID NO: 65 - DNA, 4101 bp, Artificial sequence
  Synthetic polynucleotide
gacaagaagtacagtattggattggccatcgggacgaacagcgtgggctgggccgtcatcaccgacgagtacaaggtgccatccaagaagtttaaggttctggggaataccgaccgccactcgatcaagaaaaatctcatcggggcgctgcttttcgacagcggcgagacggcggaagcgacgcggctcaagcggacggctcgtcgccgttacacccggcgtaagaaccgcatctgttacctccaggagatattcagcaacgagatggcgaaggtggacgactcctttttccaccgtcttgaggagtccttcctggtcgaggaggacaagaagcacgagcgccacccgatcttcgggaacatcgtggacgaggtggcctaccacgagaagtaccccacgatctaccacctccgcaaaaaactcgtggactcaactgacaaggccgatttgaggcttatctacctcgccctcgcccacatgattaagttccgtgggcacttcctaatcgagggtgacctcaaccccgacaactctgacgtggacaagctgttcatccagcttgtgcagacctacaatcagctctttgaggagaatccgatcaacgcatctggtgtggacgcaaaggccatcctcagcgcgcggctgagcaagtctaggcggttggagaacctgatcgcccaactgcccggcgagaagaaaaatggcctcttcggcaacctgatcgccctgtcgctggggctcacgccgaacttcaagagtaactttgacctggcggaggacgctaagctccagctatctaaggacacatacgacgacgacctggacaacctgctggcccagatcggcgaccagtacgccgacctcttcctagccgccaagaacctgtccgacgccatcctcctcagcgacatcctgcgcgtgaacacggagatcacgaaggctccgctcagcgcctccatgattaagcggtacgacgagcaccaccaagacctaactttactcaaagccctcgtgcggcagcagcttcccgagaagtacaaagagatattttttgatcagtccaagaacggttatgcgggctacatcgacggcggcgcgagccaggaggagttctacaagttcatcaagcccatcctggagaagatggacggcacggaggagctgctcgtgaagctcaaccgtgaagacctcctgcgaaagcagcgaaccttcgacaacggttcgatcccgcaccagatccacctcggggagctgcacgccatcctgaggcgacaggaggacttctaccctttcctaaaggacaaccgcgagaagattgaaaaaatcctgacgtttcgcataccctactacgtcggcccgctggcgcgcggcaactcccggttcgcctggatgacccgtaagagcgaggagacgatcaccccgtggaacttcgaggaggtcgtggacaagggcgcgagcgcgcagagcttcatcgagcgcatgaccaacttcgacaagaacctcccgaacgagaaggtgctcccaaagcactccctcctgtacgagtatttcaccgtgtacaacgagttgacaaaggtgaagtacgtgacggagggaatgcggaagcctgcgttcctctcgggcgagcagaagaaggcaatcgtggacctgctcttcaagaccaaccggaaggtgacggtgaagcagctcaaggaggactacttcaaaaaaatcgagtgcttcgactccgtggagataagcggcgtggaggaccgattcaacgcctccctcggcacctaccacgacctccttaagatcatcaaggacaaggacttcctggacaacgaggagaacgaggacatcctggaggacatcgtgctcaccctgaccctcttcgaggaccgggagatgatcgaggagcgcctcaagacgtacgcccacttgttcgacgacaaggtgatgaagcagctcaagcggcggcgatacaccgggtggggccgcctatcccgcaaacttatcaacggcatccgcgacaagcagtccggcaagacgatcctggatttcctcaagtcggacgggttcgccaaccggaacttcatgcagctcatccacgacgacagcctcacgttcaaggaggacatccagaaggcccaagtgagcggtcaaggggacagcctccacgagcacattgcgaaccttgctgggagccctgcgatcaagaaggggatattgcaaaccgtgaaggtcgtggacgagttggtgaaggtcatggggcgacacaagcccgagaacatcgtgatcgagatggccagggaaaatcagaccacgcagaagggccaaaaaaacagccgcgagcggatgaagcggatcgaggagggcatcaaggagctggggtcgcagatcctcaaggagcacccggtggagaacacgcagctccagaacgagaagctgtacctctattacctacagaacgggcgggatatgtacgtggaccaggagctagacatcaaccgcctgtccgactacgacgtggaccatatcgtcccgcagtcgttcttgaaggacgacagcatcgacaacaaggtgctcacaagatcggataagaatcgaggcaagtccgacaacgtgccctcggaggaggtggtcaagaaaatgaaaaactactggcggcagttgctgaacgccaagctcattacgcagcggaagttcgacaacctgacgaaggctgaacgtggtgggctcagcgagctagacaaggcggggttcatcaagcggcagctcgtcgagacccggcagatcaccaagcacgtggcgcagatcctggactcgcgcatgaacaccaagtacgacgagaacgacaagctcatccgtgaggtgaaggtcatcacccttaagtctaagctggtcagtgacttccgcaaggacttccagttctacaaggtccgggagatcaacaactaccaccacgcgcacgacgcctacctcaacgcggtggtggggacggcgcttattaagaaatatcccaagctggaaagcgagttcgtttacggcgactacaaggtgtacgacgtccgcaagatgatcgcaaagtcggaacaggaaatcggaaaggcgacggccaaatatttcttttactccaacatcatgaatttttttaagacggagatcaccctggcgaacggggagatccgcaagcggcccctcatcgagaccaacggggagacgggcgagatcgtctgggacaagggccgggacttcgccaccgtgcggaaggtgctttctatgcctcaagtcaatatcgtcaaaaagacagaggtgcagaccggcgggttcagcaaggagtctatcctgccgaagcgcaactcggacaagctcatcgcgcgcaagaaagactgggaccccaaaaaatatggcgggttcgactcgccgaccgtcgcctacagcgtcctcgtggtggctaaggtcgagaagggcaagagcaaaaagctaaagtcggtgaaggagctgctgggcatcaccatcatggagcgctcgtctttcgagaagaatccaatcgacttcctagaggcgaaggggtacaaggaggtcaaaaaggatcttatcatcaaactgccgaagtacagtctgttcgagctggagaacgggcggaagcggatgctggctagtgcgggcgagttgcagaagggcaacgagttggcactgccctccaagtacgtgaacttcctgtacctggcctcccactacgagaagctcaaggggagccccgaggacaacgagcagaagcagctattcgtcgagcagcacaagcactacctggacgagatcatcgagcagatcagtgagttctccaagcgggtcatcctcgcggacgccaacctggacaaggtgctgagcgcgtacaacaagcacagggacaagccaatcagggaacaggccgagaacatcatccacctgttcaccctgaccaacctgggtgcaccggctgccttcaagtactttgacacgaccatcgaccggaagcgctacacctccacgaaggaggtgctggacgccacgctgatccaccagagcatcaccgggctctacgagacacggatcgacctgagccagcttggcggggac

SEQ ID NO: 66 - DNA, 4092 bp, Artificial sequence
  Synthetic polynucleotide
gacaaaaagtattccattggactcgctatcggcacgaacagcgtcgggtgggcggtcatcactgacgagtacaaggtgccgagcaagaagtttaaggtgctgggaaacaccgacaggcactcgatcaagaaaaatcttatcggggccctactcttcgactccggagaaaccgccgaggccacccggttgaagcgcacggcccgccgtcgctacaccaggcgcaagaaccggatctgctacctccaggagatattcagcaatgagatggcgaaggtggacgactcgttttttcacaggctagaggagtctttcctcgtggaggaggacaagaaacacgagcgccaccccatcttcggcaacatcgtggatgaggtggcatatcacgagaagtacccaaccatctaccacctccgcaaaaagctcgtggactctaccgacaaggccgacctccgtctgatctacctcgcgctggcccacatgattaagttccgaggacactttctgatcgagggcgacctgaacccagacaacagcgacgtggacaagctgttcatccaacttgtccagacctacaatcagctcttcgaggagaaccctatcaacgcctcgggcgtggacgcgaaggccatcctgtccgcccgcctgagcaagtcgcggcggctggagaacctgatcgcccagctccccggcgaaaaaaagaacggcctcttcggcaacctcatcgcgttgtcgctggggctcaccccgaacttcaagtccaacttcgacctggccgaggacgctaaactccagctctcgaaggatacctacgacgacgacctcgacaacctgctggcccagatcggcgaccagtacgcggaccttttcctggcggccaagaacctgagcgacgcgatcctccttagcgacatactccgtgtgaacaccgagatcacgaaggccccgctctccgcgtccatgattaagcgctacgacgagcaccaccaagaccttaccctgcttaaggcgctggtcaggcagcagttaccggagaagtacaaggagatcttttttgatcaatctaagaacggttacgccgggtacatcgacggcggcgcgtcccaggaggagttctacaagttcatcaagccgatcttggagaaaatggacgggaccgaggagctgctcgtgaagctcaaccgcgaagacctcctccgcaagcagcgcaccttcgacaacgggagcatcccgcaccagatccacctgggagagctgcacgcgatcctgcggagacaagaggacttctaccccttcctcaaggacaaccgggagaagattgaaaaaatacttacttttcgtatcccgtactacgtcgggccccttgcgaggggcaactccagattcgcgtggatgacccgcaagtccgaggagaccatcaccccgtggaacttcgaggaggtggtggacaagggcgcgtcggcccagtcgttcatcgagcgcatgaccaacttcgacaagaaccttccgaacgagaaggtgctcccgaagcacagcctgctctacgaatattttactgtgtacaacgagctgacgaaggtcaagtacgttacggaggggatgaggaagcccgccttcctctccggcgagcagaagaaagccattgtggatctcctgttcaagaccaaccgcaaggtgacggtgaaacagctcaaagaggactacttcaagaagatcgagtgcttcgactccgtagagatcagcggggtcgaggaccgcttcaacgcctcgctgggcacgtaccacgacctgctaaagattatcaaggacaaagacttcctagacaatgaggagaacgaggacattctggaggacatcgtgctgactctgacgctgttcgaagaccgcgagatgatcgaggagcggcttaagacgtacgcccacctgttcgacgacaaggtgatgaagcagttgaaacggcggcgctacaccgggtggggccgcctctcccgcaagctcatcaacggcatccgcgacaagcagtcggggaagacgatcctggacttcctcaagagcgacggcttcgccaaccgaaacttcatgcagctaatccacgacgacagcctgacgttcaaggaggacatccagaaggcccaagtgagcggccagggagactcgctacacgagcatatcgccaacctggctggcagcccggcgattaagaaaggaatcctccaaaccgtcaaagtggtggacgagctggtgaaggtgatgggccgccacaagcccgagaacattgtgatcgagatggcgcgggagaaccagacgacgcagaagggccaaaaaaatagcagggaaaggatgaagcgaatagaggaggggatcaaggagctggggagccagattctcaaagagcacccggtcgagaacacacagctccagaacgagaagctgtacctctactacctccaaaacggccgcgatatgtacgtggaccaggaactagacatcaaccggctgagcgactatgacgtggaccacatcgtgccgcagtccttcctcaaggacgactcgattgacaacaaagtgctcactagatccgacaagaacagaggcaagagcgataacgtcccgtcggaggaggtcgtcaagaaaatgaaaaactactggcggcagctcctaaacgccaagctcatcacgcagcgtaagttcgacaacctgacgaaggcggagcggggcgggctgagcgagctggacaaagcggggttcatcaagcggcagctcgttgagacgcggcagatcacaaagcacgtcgcgcaaatcctcgactcccgcatgaacaccaagtacgacgagaacgacaagctcatccgggaggtgaaggtcattacccttaaatcgaagctcgtcagcgactttcgtaaggacttccagttctacaaggtcagagagatcaacaactaccaccacgcccacgacgcctatctgaacgccgtggtgggcaccgcgcttattaagaagtaccccaagctggagtccgagttcgtgtacggcgactacaaggtttatgacgtcaggaagatgatcgccaagtcggaacaggagatcggaaaagctaccgccaaatatttcttctatagcaacatcatgaacttcttcaaaaccgagatcaccctcgccaacggcgagatccggaagcgcccgctcatcgagaccaacggggagaccggggagatcgtctgggacaaggggcgggacttcgctactgtccgaaaggtgctctccatgccacaagtgaatatcgtcaagaaaacagaggtgcagaccggagggttcagtaaggagtccatcctgcccaagcggaactccgacaagctaattgctcgcaaaaaggattgggatcctaaaaaatatggcggcttcgactcgcccacggtcgcctactctgtgctggtcgtggcgaaggtggagaagggcaagtccaagaagctcaagagcgtcaaggagctgctggggatcacgatcatggagcgtagttcgtttgagaagaatcccatcgacttcctggaggctaagggctacaaggaggtcaaaaaggacctcatcattaagctgccgaagtacagcctcttcgagctggagaacgggcggaagcgtatgctcgcctccgctggggagttacaaaaggggaacgagctggcgctgccgtctaagtacgtcaacttcctgtacctggcctcccactacgagaagctcaaggggtcgccggaggacaacgagcagaagcagctcttcgtagagcagcacaagcactacctggacgagatcatcgagcagatttcagagttctcaaagcgggtcatcctcgccgacgccaacctggacaaggtgctctcggcctacaacaagcaccgggacaagccgatccgcgaacaggccgaaaacatcatccacctgttcacgctcaccaacctcggtgccccggcggccttcaagtactttgacacgaccatcgaccggaagcgctatacctcgacgaaggaggtgctggacgccaccctgatccaccagtccatcaccgggctttacgagacccggatcgacctctcgcagcta

SEQ ID NO: 67 - DNA, 4101 bp, Artificial sequence
  Synthetic polynucleotide
gacaagaagtatagtattggactcgccatcggaaccaactctgtggggtgggctgttattacagatgaatataaggtgccatccaaaaagtttaaagttctgggcaatactgatagacactcaatcaagaagaatctgataggtgcacttctgtttgatagtggagagactgccgaggcaaccagacttaaaaggactgcaagaagaagatataccagaagaaagaataggatttgctatttgcaggaaatcttcagcaacgaaatggccaaggttgatgactcatttttccataggttggaggagagttttcttgtggaggaagataagaagcacgaaagacacccaattttcgggaatatagtggacgaggtggcttatcatgagaagtatcccactatctaccacctgagaaagaaacttgtggactcaaccgataaggctgatcttaggcttatatacttggcccttgcacatatgatcaaattcaggggccattttcttatcgaaggcgatcttaatcccgataactcagatgtggacaagctgtttatacaacttgtgcaaacctacaatcaactcttcgaggagaatcccattaacgcctccggcgtggatgcaaaagccatactgtcagccagactgagcaaaagtaggagactggagaatcttatagcccaactgcccggtgaaaagaagaatgggctcttcggaaatctgatcgctctttcattggggttgacacccaactttaagagtaactttgacttggcagaagatgcaaagttgcagctcagtaaagacacatatgacgatgaccttgacaatctcttggcacaaataggggatcaatacgctgaccttttcctcgctgccaagaacctcagcgacgctatactgttgtccgacattcttagggttaataccgaaattacaaaggcccctcttagtgcaagtatgatcaaaaggtatgatgagcatcaccaagaccttacactgctgaaggctctggttagacagcaactccctgaaaagtataaggaaatattcttcgaccaaagtaagaacgggtacgccggttatattgatgggggcgcaagtcaagaagaattttacaaattcatcaagccaattcttgaaaagatggacgggactgaggaattgctggtgaaactgaatagagaggaccttcttagaaaacagaggacatttgacaatgggtccatcccacaccagattcatctgggggaactccacgcaatattgaggagacaagaagacttttacccattccttaaggataatagagagaaaatcgaaaaaatcctgactttcaggattccttactatgttgggccactggccagggggaactcaagattcgcttggatgacaaggaagtcagaagaaaccataaccccttggaattttgaagaggtggttgataagggggcatcagcccagtctttcatagagaggatgaccaactttgataaaaatcttccaaatgagaaggttttgccaaaacatagtcttttgtacgagtactttactgtttataacgaattgaccaaggtgaagtatgtgaccgagggaatgaggaagccagcatttttgtccggggagcaaaagaaagcaatcgttgatcttctcttcaagaccaacagaaaagtgaccgtgaaacaactgaaggaagactacttcaaaaagatagaatgtttcgattcagtggaaattagcggtgttgaagacaggttcaatgcttcattgggtacttaccacgacctgttgaagataatcaaagacaaggactttctcgataatgaggagaacgaagacatcttggaagacattgtgcttacactcactttgtttgaggacagggaaatgattgaggaaagactcaaaacttacgctcatttgtttgatgataaggttatgaaacaactaaaaagaagaaggtacaccggctggggaagattgagtaggaaactgatcaacggtattagagataaacaatccggaaagactatcctcgatttccttaagagtgatggctttgcaaataggaattttatgcagctgattcatgacgactcacttaccttcaaagaagacatccaaaaagctcaggtgtctgggcaaggcgacagtctgcatgaacatatagctaacttggctgggagtcccgccatcaagaaggggatacttcaaacagttaaagttgtggacgaattggtgaaggtaatgggaaggcacaagcctgaaaatatagtgatagaaatggcaagggaaaatcaaacaacccagaagggacagaagaacagtagggaaaggatgaaaaggatagaagaggggatcaaagagcttggtagccagatcctcaaggaacatccagtggagaatacccaacttcaaaacgagaaactctatttgtactacttgcagaacggaagagatatgtatgtggaccaagagcttgatattaacaggctgagcgattatgacgttgaccacatagtgccccaatcattcctcaaggatgactctattgataataaggtgctgacaaggagtgacaagaatagagggaaatccgacaacgttccatccgaggaagttgtgaagaagatgaagaactactggaggcagttgctgaacgctaagctcattacccagaggaaattcgataacctgaccaaagcagagagaggcgggctgagcgaactcgataaagcaggtttcatcaagagacaactcgtggagactaggcaaattactaagcacgtggctcaaatactcgacagcaggatgaacacaaagtacgacgagaacgacaagctcattagagaggttaaggttattactctgaaaagtaaattggttagcgatttcagaaaggatttccaattctataaggttagagagatcaacaattatcatcatgcacatgatgcctatctgaatgctgtggttggtacagcccttatcaagaagtaccctaagctagagagcgagtttgtgtacggagattataaggtgtatgatgtgaggaaaatgatcgctaaaagtgagcaagagattggaaaggctaccgccaaatacttcttttattccaatattatgaatttcttcaagacagaaatcaccctggctaacggcgagataaggaagaggccgcttatcgaaactaatggggagacaggcgaaatagtgtgggacaaagggagggatttcgcaactgtgaggaaggttttgagcatgcctcaggtgaatatcgttaagaaaaccgaagttcaaactggagggttctctaaggaaagcattctccccaagaggaactccgacaagctgattgctagaaagaaagactgggaccccaagaagtatggcggattcgactcacccactgtggcatatagcgttctcgtggtggcaaaggttgaaaagggtaaatccaaaaaactcaaatccgtgaaggaactccttggcataactattatggaaaggagtagctttgaaaagaatcccatcgactttctcgaagctaagggctataaggaagttaagaaggaccttataatcaaacttccaaaatactccctttttgagttggaaaacggcagaaagagaatgttggccagtgccggggagcttcaaaagggcaacgaactggctctgcctagcaaatatgtgaactttttgtatctggcatcacactacgagaaacttaaaggctctcctgaggacaacgagcaaaaacagctctttgttgaacagcataagcactacctcgacgagattattgagcagatcagcgagttctcaaagagagttattctggctgacgctaatcttgacaaggttttgtccgcttacaacaaacacagggataagccaatcagggagcaggcagaaaacataatccatctctttaccctgacaaacctcggtgcccccgctgctttcaagtattttgatactaccattgacaggaagagatatacttccactaaggaagtgctcgacgcaaccctcatacaccaaagtatcacaggcctctatgaaactaggatagatttgtctcaacttgggggcgat

SEQ ID NO: 68 - DNA, 4101 bp, Artificial sequence
  Synthetic polynucleotide
gacaaaaagtattccatcgggcttgctatcggaaccaactctgtggggtgggcagttattaccgacgaatacaaggtgcccagcaagaagtttaaggttctggggaacacagatagacatagcataaagaaaaacctgataggcgcactgttgttcgactccggggaaacagccgaagctaccaggctgaagagaactgcaagaagaaggtacaccagaagaaaaaacagaatatgttatctccaagagattttctctaacgagatggccaaggtggacgactcattctttcacagactggaagaatctttccttgtggaagaagataagaaacacgagaggcaccctatttttggcaatatcgtggatgaggtggcttaccacgaaaaataccctacaatataccacctcaggaaaaaattggttgatagtacagacaaggccgacctcaggctcatctatttggccctggcccatatgattaaattcagggggcactttctcatcgagggagatttgaaccccgacaacagtgatgttgataagctctttattcagctcgtgcagacttacaatcagttgtttgaggaaaaccccattaatgcttccggggtggacgccaaggcaatcctttctgcaagactctcaaagtcaaggagactcgaaaatctgatagcacagcttccaggagagaagaagaacgggctctttggaaacctgatcgctctgtcactcggactcacacccaatttcaaaagcaattttgatttggcagaggacgctaagctgcaactcagtaaggatacctacgacgatgacttggataatctgctcgcacaaattggggaccagtatgcagacctgtttctcgcagctaagaacttgagtgacgccatattgctcagtgacatcctcagggttaataccgagattacaaaagctccactctctgcaagcatgatcaagaggtatgacgagcaccatcaagacctgacactccttaaggcgttggttaggcagcaacttcctgaaaagtataaggaaatcttcttcgatcaaagcaaaaacggctacgccggctatatagacgggggagcatcccaagaagaattttataagttcataaaacctatattggagaagatggacgggacagaggaattgctcgtgaaactgaacagggaggatctcctcaggaagcaaaggaccttcgacaatggctccatcccacatcagattcacctcggcgaactgcacgcaatactgagaagacaagaggacttttatcctttcctgaaggacaacagggagaaaatcgagaaaatcttgacattcagaatcccatactacgttgggcctctggccagaggtaacagtaggttcgcctggatgactaggaaatcagaggagactattacaccctggaactttgaagaagttgttgataagggagcttcagcacaatcattcatcgaaagaatgacaaactttgacaaaaatctgcctaatgagaaagtgctcccaaaacattccctgctgtatgagtattttaccgtttataacgagcttaccaaggtgaaatacgttactgaaggtatgagaaagccagcttttctttcaggggagcaaaagaaggctatcgtggatcttctctttaagaccaacagaaaggttaccgtgaagcagcttaaggaagactactttaaaaagatcgagtgttttgactcagtggaaataagcggtgttgaagatagattcaacgcatccttgggaacttatcatgatcttcttaagataatcaaggataaagactttctcgacaacgaggaaaacgaagatatactggaggacatagttctgacacttactttgttcgaggatagggagatgatcgaggaaagactgaaaacatatgctcaccttttcgacgacaaagttatgaaacaactcaagagaaggagatatacagggtgggggagattgagcaggaaactgattaatggtatcagagacaaacagtcaggaaaaacaatactcgactttttgaaatcagacgggttcgcaaataggaatttcatgcagcttatacacgacgattcacttacttttaaagaggacattcaaaaggctcaagttagtggacaaggtgactccctccacgaacacatcgcaaatctcgctggcagccctgcaattaagaagggtatactccagacagttaaggttgttgacgagctggttaaagtgatgggaagacacaaacccgagaacatagtgatagagatggccagggaaaaccaaaccactcaaaaagggcagaaaaattccagagagaggatgaaaaggattgaagaaggtatcaaggagctgggtagccaaattctgaaagaacatcctgtggaaaacactcaactccagaatgagaaactctatctgtactatctgcaaaatgggagagatatgtatgtggaccaggaactggacataaacaggctctcagattacgatgtggatcatatcgtgccacagtcctttcttaaggatgatagcatcgacaataaggtgcttaccaggtccgacaagaacaggggaaagtcagataacgtgccttctgaagaagttgttaaaaagatgaagaactactggagacagctgcttaacgctaagctcataacacagaggaagtttgacaacttgaccaaggccgagagaggcggactctcagaattggataaggcagggttcataaaaaggcagctggtggaaacaaggcagataactaaacatgtggctcagatcctcgatagtaggatgaatacaaaatacgatgagaacgacaagctcataagggaggttaaagtgataactctgaaatccaaactggttagcgattttaggaaggatttccagttttacaaagttagggagatcaacaattatcatcacgcccacgatgcctacttgaacgcagttgtgggtactgcacttatcaaaaagtaccctaagctggaatccgagtttgtttatggagactataaggtgtacgacgttagaaaaatgattgcaaagtcagagcaggagatagggaaagccactgcaaaatatttcttttatagcaatatcatgaatttctttaagacagaaatcacactggccaatggggaaataaggaagaggcccctgatcgaaactaatggcgagacaggggagattgtgtgggataaaggtagggactttgcaacagtgaggaaagtgctgagcatgccccaagttaatatcgttaaaaagaccgaggttcaaacagggggctttagtaaggaaagcattttgcccaagaggaatagtgacaaattgattgctaggaaaaaagattgggaccccaaaaagtatggcggatttgatagccccactgttgcttactccgtgctcgtggttgcaaaggtggagaagggaaagagcaagaaactgaagtcagttaaggaactccttggtatcactatcatggaaagaagctcctttgagaagaaccctattgacttcctggaggctaaagggtacaaagaggttaagaaagaccttatcattaaattgcccaaatatagtcttttcgagcttgaaaacggaagaaagaggatgcttgcatccgctggcgaattgcaaaagggcaatgagcttgctctcccttccaagtatgtgaacttcctttatcttgcctcacactatgaaaaactcaaaggttcacccgaagacaacgaacaaaagcaactatttgtggaacaacacaagcactacctggacgaaatcattgagcaaatttctgagttttcaaaaagggtaatcttggctgacgcaaatctcgacaaagttttgtcagcttacaacaaacatagagataagccaattagagagcaagctgagaatatcatccatctgtttaccctgactaaccttggagcgcctgctgcttttaaatatttcgacaccacaatcgacaggaagaggtacactagcactaaggaagttctcgacgccaccctcatccaccagagtattacaggcctgtacgagacaagaattgatctttctcaacttggtggtgac

SEQ ID NO: 69 - DNA, 4101 bp, Artificial sequence
  Synthetic polynucleotide
gataagaagtactcaatcggtctggcaatcggaaccaactctgtgggttgggcagtgattacagatgagtataaggtgccaagcaaaaaattcaaggtgctgggtaataccgacagacacagcattaagaagaatttgattggagcactcctctttgactcaggggaaacagcagaggcaacaaggctgaagaggacagcaaggcggaggtacacaaggcggaaaaacaggatatgctacctccaggaaatctttagcaacgagatggctaaagtggatgatagctttttccatagactcgaagaatcctttcttgttgaagaggacaaaaagcatgaaaggcatcccatcttcggcaatatagttgatgaggttgcataccatgagaagtaccccacaatctaccacctcagaaagaaacttgtggactccacagataaagcagacctgaggctcatatacctcgcactcgcacacatgatcaagttcagagggcactttctcatcgaaggtgacctgaatccagataattcagatgtggataaactgtttatacagctggtgcaaacatacaaccaacttttcgaggaaaacccaatcaatgcctccggtgttgatgcaaaggccatcctgtcagcaagactcagcaaaagcaggcggctcgaaaacctcatcgcccagcttcccggtgaaaagaagaacgggctctttggtaatctcatcgcattgagccttggtcttactccaaacttcaagagcaattttgatctggcagaggatgctaaactgcaactctcaaaggacacatatgacgatgaccttgacaatctgttggcccagatcggggaccaatatgcagacctcttcctggccgcaaagaatctgtcagatgcaatcctcttgtccgacatactgagagttaacactgagatcacaaaggcacctctgtccgcctccatgattaagagatacgatgagcatcaccaggatctgactttgctcaaagccctcgttagacagcagttgccagaaaagtacaaagaaatattctttgatcaatcaaaaaacggatatgcagggtacatcgacggtggggcaagccaggaagagttctacaaattcatcaaacctatcctggaaaagatggatgggacagaagagctgctggttaagctgaatagggaagacctcctcagaaagcagaggacatttgataacgggagcatccctcatcaaatccacctcggtgaactccatgctatcctgagaaggcaggaagacttttatccatttttgaaggacaatagggagaaaatcgaaaaaatcctgacattcagaatcccatactacgttggtcctctggcaagaggtaacagtaggttcgcatggatgacaaggaaaagcgaggagacaatcacaccctggaattttgaggaagttgttgacaagggtgccagcgcacaatcctttatcgaaagaatgacaaatttcgacaagaatctgcctaacgaaaaggttctcccaaagcattcactcctgtacgaatattttacagtttataacgaactgactaaagttaaatacgttaccgagggtatgaggaagccagcattcctttccggggaacagaagaaagctattgtggacctcctgttcaagacaaatagaaaagtgacagttaagcaactcaaagaggattacttcaaaaagatcgaatgttttgactctgtggagatcagcggggtggaggatagattcaacgccagcctgggtacatatcatgatctcctgaaaatcattaaagacaaggacttccttgacaacgaggagaacgaggacattctggaagacattgttctgaccctcacactctttgaggatagggagatgattgaggaaagactgaagacctacgcccacctctttgacgataaagtgatgaaacagctcaagagaagaaggtatacaggttgggggagactgagcaggaagttgatcaatgggattagggacaaacagtccgggaaaacaatcctcgattttctgaagtcagacggtttcgcaaacagaaattttatgcagctcattcacgatgacagcttgacattcaaggaagacatccaaaaggctcaagtgagcggccaaggggatagcctccacgagcatattgcaaatctggcaggttcaccagccatcaaaaagggcatacttcagacagttaaggttgtggacgaattggttaaagttatgggcaggcataagccagagaatatcgttatcgaaatggcaagggagaaccaaacaactcaaaaagggcagaaaaatagcagagagaggatgaaaagaatcgaggaagggatcaaggaacttgggtcccaaatcctcaaggagcacccagttgaaaatactcaactgcaaaacgagaagctctatctctactatctccaaaacgggagggatatgtatgttgaccaggagctggatattaacagactgtcagattatgatgttgatcatatcgtgccccagtcattcctgaaggacgattccatcgacaacaaagttctcacaaggtccgataaaaacaggggcaagtccgataacgttccaagcgaagaagtggtgaaaaagatgaaaaactattggagacaacttctgaatgcaaagttgattactcagagaaagtttgacaacctcacaaaagcagaaagaggcgggcttagcgaactcgataaggcagggtttatcaaaagacagctggttgagacaaggcagatcacaaaacatgtggcacagatccttgactcaaggatgaataccaagtatgatgagaatgataagttgatcagggaggttaaagttatcacactcaaatccaaactggtgtcagacttcaggaaagactttcaattttataaggtgagggagatcaataactaccaccatgcacatgacgcctacctgaacgcagtggtgggtacagcattgattaaaaaataccctaagctggagtctgagtttgtgtacggggactacaaggtgtacgacgtgaggaaaatgatagccaagtccgagcaggagatcgggaaagcaacagctaagtatttcttttacagtaatatcatgaatttctttaaaactgagattactctggcaaacggggagatcaggaaaagacccctcatcgagactaatggtgaaacaggtgagatcgtttgggacaaggggagggattttgctactgttagaaaagttctgagtatgccacaagtgaatattgtgaaaaagacagaagttcagacaggtgggttctccaaagaatccatcctgcccaagagaaattcagacaagctcatcgcaagaaagaaggactgggaccctaagaagtacggaggatttgacagccccaccgtggcctattccgtgcttgttgtggcaaaggtggagaaagggaagagcaaaaaactgaaatccgtgaaagaactgctgggaattaccatcatggaaagaagctcctttgagaagaacccaatcgacttcctggaagcaaaaggatataaggaagtgaaaaaggacctcattatcaagctcccaaaatactcacttttcgagttggagaacggtagaaagaggatgctggcaagcgcaggggaacttcagaaaggcaatgagctggcattgccatcaaagtatgtgaacttcctctacttggccagccattacgagaaacttaaaggtagcccagaagataacgagcaaaaacagctctttgtggaacagcataagcattatctggatgagatcatagaacaaatctcagagttttccaagagagttatcctcgcagatgcaaacctggataaggttctctcagcctataataagcatagagacaagccaattagagagcaagcagagaacattatccacttgttcactcttacaaacctgggggcaccagccgccttcaaatatttcgatacaacaatagacagaaagaggtataccagcaccaaagaagttctcgacgccacactgatccatcaatcaatcacaggcctttacgaaactaggatcgacttgtcacaactgggtggggat

SEQ ID NO: 70 - DNA, 3307 bp, Artificial sequence
  Synthetic polynucleotide
gagcaaggacacctacgacgacgacttggacaacctattggcccagataggtgaccagtatgcagacctcttccttgcggccaagaacttgagtgacgctatactgctcagtgacatcctgagggtgaacactgagatcactaaggcccctctctctgcctcaatgattaagcgttacgacgagcatcaccaggatctcaccctgcttaaggcccttgttcggcagcagctccctgagaagtacaaggagatattttttgaccagtctaagaacggctacgccggttacattgacggtggggcaagccaggaggagttctacaagttcatcaagccgatccttgagaagatggacggcaccgaggagctacttgtcaagttgaaccgggaagacctgctccggaaacagcgtacattcgacaacggcagcatccctcaccagatccacctgggcgaactacacgccatcctccgacgtcaggaggacttctatccattcttgaaagataacagggaaaaaatcgaaaaaatacttacgtttcgaataccttactacgtggggccccttgctcggggaaactccagattcgcatggatgaccaggaagtcagaggagaccatcacaccctggaactttgaggaggtggttgacaaaggtgcttctgcccagtccttcattgagcggatgactaacttcgacaagaacctgcccaacgagaaggtgctgccaaagcacagcctgctctacgaatactttactgtgtacaatgagctgacgaaggtgaagtacgtgacagaggggatgcggaagcccgctttcctgagcggcgagcaaaaaaaagcaatcgtggacctactgttcaagaccaaccgaaaggtgacagtgaagcagctcaaggaggactacttcaaaaaaatcgagtgcttcgactctgttgagataagcggcgtggaggaccgattcaacgcctcattgggaacctatcacgacctgctcaagatcattaaggacaaggacttcctggataatgaggagaatgaggacatcctggaggatattgtgctgacccttactctattcgaggacagggagatgatcgaggagcgactcaagacctacgctcacctgttcgacgacaaggttatgaagcaattgaagcgtaggcgatacacggggtggggaagactctcccgaaaactgataaacggcatcagggacaagcagtcagggaagacgatcttggacttcctgaaatccgacgggttcgccaaccgcaacttcatgcagctcattcacgacgactcactaacgttcaaagaggacattcagaaggctcaagtcagtggacaaggcgactccctgcacgagcacattgcaaaccttgcgggctccccggcgattaaaaagggcattctccaaacggttaaggtggtggacgagctggtgaaggtgatgggccgacacaagcctgagaacatcgtgatcgagatggccagggagaaccagactacccagaagggtcagaagaactctcgggaacgtatgaagcgtattgaggaggggattaaggagttgggctctcaaatcctcaaggagcaccctgtggagaacactcagctccaaaacgagaagctgtacctgtactacctgcaaaacgggcgcgatatgtacgtggatcaggagttggacatcaacaggcttagcgattacgacgtggaccacatcgtgccacagtcattcttaaaggacgacagcatcgacaacaaggttctgacgaggagcgacaagaatcgagggaaaagtgacaatgttccatccgaggaggtggtcaagaaaatgaagaactattggcgtcagcttctgaacgccaagctcatcacccagcggaaattcgacaacctgactaaggctgagcgaggcggactctccgagcttgacaaggctggcttcatcaagcggcagttggtcgaaacccgacagataacgaagcacgttgcccagatacttgactcccgtatgaacaccaagtacgacgagaacgacaagctcatcagggaggtgaaggtcattacccttaagtccaaactcgtcagcgactttcgtaaggacttccagttctacaaggtgcgcgagatcaataactaccaccacgcacacgacgcctacctgaacgcagtggttggaaccgcgttgattaaaaagtaccccaagttggagtcggagttcgtttacggggactacaaggtgtacgacgttcggaagatgatcgccaagtctgaacaggagatcgggaaagcaaccgccaagtatttcttctatagcaacatcatgaacttctttaaaaccgagatcacacttgccaatggcgagatccgtaagaggccgctgatcgagacaaatggggagactggcgagatcgtgtgggacaagggccgcgacttcgcaaccgttcggaaagtcttgtccatgcctcaagtcaacatcgtcaagaagactgaggtgcaaacaggcgggttctcgaaggagtccatactgcccaagaggaactcagacaagctcatagcacgcaaaaaagactgggatccaaagaaatacggcgggttcgactcgccgacagtcgcatactccgtgttagtggtggctaaagtggaaaaggggaagtccaagaagctcaagtccgtcaaggagttgctcgggatcaccattatggaacggtcctcattcgagaagaatcccattgacttcctagaggcgaagggctacaaagaggtcaaaaaggacctaattattaagctccccaagtattcactcttcgaacttgaaaatggtcgtaagcggatgttggcaagcgctggagagcttcagaaggggaacgagcttgcactgccttccaagtacgtgaacttcctgtacctcgcctctcattacgagaagttgaagggctcaccggaggacaacgagcagaagcagttgttcgtggagcagcacaagcactacctcgacgagatcattgagcagataagtgagttcagcaaacgggtgatccttgccgacgctaacctggacaaggtgctgagcgcctacaacaagcacagagacaagccgatccgagagcaagcggagaacatcatacacctgttcaccctcacgaacctcggggctcccgcagccttcaaatattttgacacgaccatcgaccgtaaacgctacactagcacgaaggaggtgctggacgctacccttatccaccagtccatcaccggcctgtacgagacgagaatcgacttgtcgcagctcggtggtgac

SEQ ID NO: 71 - DNA, 4101 bp, Artificial sequence
  Synthetic polynucleotide
gacaaaaaatactcaattggtctggcaattgggaccaacagtgtcggatgggccgtgattaccgacgagtacaaggtgccgtccaaaaaattcaaggtgcttgggaacaccgaccgccactcgatcaagaaaaacctaatcggtgcgttgcttttcgacagtggggagaccgccgaggcaacacgcttaaaacgcacagctaggaggagatatacacggcgcaagaaccgaatatgctacttacaggagatattctccaatgagatggcgaaggtggacgactctttcttccatcggcttgaggaatccttcctggtcgaggaggacaagaagcacgagcgacacccgatattcgggaacatcgttgatgaggtggcgtaccacgagaagtacccaacgatataccacttacgcaagaagctcgtggactctacggacaaggccgacttgcgccttatctacttggcactggcccacatgattaagttccgaggccacttccttatcgagggtgacctgaaccccgataactccgacgtggacaagctcttcatccaactcgtccagacatacaaccagctattcgaggagaatcctatcaacgcctctggggtggacgctaaagctatcctctcagcccgcctgtcaaagtcgaggaggttggagaacctaatcgcccagcttccaggcgagaagaaaaatgggctgttcggaaaccttatcgcactctcactgggcctaaccccgaacttcaagtccaacttcgacctggcagaggacgcgaaattgcagttgtcgaaagacacctatgacgatgacctggacaacctgttggcccagataggggaccagtacgccgacctgttcctagcggccaagaacctgtccgacgccatcttgctgtcggatatactgcgggtgaacaccgagatcactaaagcacctctctccgccagcatgattaagcgttacgacgagcaccaccaagatttgaccctgctaaaggcacttgtacggcagcagcttcccgagaagtacaaggagatctttttcgaccaaagcaagaacggctacgccgggtacatcgacggaggtgccagccaggaggagttctacaagttcattaagcccatcctggagaagatggacgggactgaggaactacttgtgaagctgaaccgggaagacttactacggaagcagcgtaccttcgacaacggttctatcccacatcagatccatcttggggagttgcacgcgatcctgcgacgccaggaggacttttaccccttcctgaaagacaaccgcgagaaaatcgagaagatactgaccttcagaataccttactacgtcggaccccttgcgcgaggcaactcaagattcgcgtggatgaccaggaaatcagaggagaccatcacaccctggaatttcgaggaggtggttgacaagggtgcctccgcccagtcctttatcgaacgaatgaccaacttcgacaagaacttgcccaacgagaaggtgctccccaaacacagcctcctctacgaatatttcacagtgtacaacgagcttactaaagttaagtatgttactgagggcatgaggaaacccgccttcctgtcaggcgagcagaagaaagctattgtggacctccttttcaagaccaaccggaaggtgacagtgaagcagctcaaggaggactacttcaagaagatagagtgcttcgacagcgtggagatcagcggggtggaggacagattcaatgcctctctcggaacataccacgacttgcttaagatcatcaaggacaaggacttcctcgacaacgaggaaaacgaggatattctggaggatattgttctgactcttaccctgttcgaggaccgggagatgatcgaggagcgtctcaagacctacgcccacctgttcgacgacaaagttatgaagcagctcaagcgtcggagatataccggatggggccgtctgtctcggaagctcatcaacgggatcagggacaagcagtcagggaagacgatcttagacttccttaagtctgacggcttcgccaacaggaacttcatgcagttgatccacgacgacagccttaccttcaaggaggacatccagaaggcccaagtgagtggccagggtgacagcctccacgagcatattgctaatcttgcgggttccccagcgattaaaaagggcatacttcaaaccgttaaggtggtggacgagcttgtcaaggtgatggggcgacacaagcccgagaacatcgtgatcgagatggccagggagaaccagaccacccagaaggggcagaagaatagccgagaacgcatgaagcgcatcgaggaggggattaaggagctagggagccagatcctcaaggaacatcccgtcgagaacacccagctccagaacgagaagctatacctctactacttgcaaaacgggagggatatgtacgtggatcaggagttggacattaaccgcctaagcgactacgacgtagatcacatcgtgcctcagtcattcctcaaagacgacagcattgacaacaaagtcttgacccgatccgacaagaaccgaggaaaatccgacaatgtgccctcagaggaggtcgtcaagaaaatgaagaactattggaggcagctacttaacgccaaactcataacccagcggaagttcgacaacctgacaaaggctgagcggggtgggctcagcgagcttgacaaggctggcttcatcaagcggcagttggtggagacaagacagataacgaagcacgtggctcagatcctggactctcgcatgaacacgaagtacgacgagaacgacaaattgatccgcgaggtcaaggttattacgctcaagagcaaacttgtcagcgatttccgcaaggacttccagttctacaaggtgagggagattaacaactaccaccatgcacatgatgcctacttgaacgcagtggtggggaccgcgcttattaaaaagtaccctaagttggagtcagagttcgtttatggggactacaaggtgtacgacgtccggaagatgattgcaaagtctgaacaggaaatcgggaaggccaccgccaaatatttcttctacagtaacattatgaatttttttaagactgaaattactctcgcaaacggcgagatcaggaagcgtcccctcatcgagacaaacggggagaccggggagatagtctgggacaaggggcgggacttcgctacggtgaggaaggtgctctcgatgccacaagtgaacatcgtcaaaaagacagaggtgcagaccggtggcttctcaaaggagtcaatcctgccaaaacgtaacagcgacaagctcatcgcccgcaagaaagactgggaccctaagaagtatggtgggttcgactcaccgacggtcgcatactccgttctggtcgtggcaaaggtggaaaagggcaagtccaaaaaactgaaatccgtgaaggagttgcttggcattaccatcatggaacgcagcagcttcgagaagaaccccattgacttcctggaggctaaagggtacaaggaggtcaagaaagatttaattattaagctacctaagtacagcttgttcgagctggagaacggccgaaaacgaatgctcgcatccgccggggaacttcaaaagggcaacgagcttgcgctgccctccaagtacgtgaacttcctgtacttggcatcccactacgagaaactcaagggtagcccagaggacaacgagcagaagcagctattcgtggagcagcacaagcactacctcgacgagataatcgagcagatcagtgagttcagtaagcgggtgatactcgcggacgccaacttggacaaggtgcttagtgcctacaacaagcaccgtgacaagcccatccgagaacaggctgagaacatcatccaccttttcactctgacaaacctcggtgctcccgccgccttcaaatacttcgacactaccatcgacaggaagcgctacacatctacgaaggaagttcttgacgctacgcttattcatcagtctatcacagggctgtacgagacaaggatcgaccttagccaactcggcggggat

SEQ ID NO: 72 - DNA, 3087 bp, Zea mays
atgaggccttcgccacctttgctcctgttcgtgctcctgcacttcgcgctcctgtccaccattgccgccgccgatgggaatgggaatgggaatgggaacggcgacctgcgcggcgacgcgatggcgctgctcgccctcaaggccgcgctcggctgccggccgggcgcgctgcggtcgtggtcggagggcaatgccgggtccgtgtgcgcgtggacgggcgtccggtgcgcggccggacgcgttgtcgccgtcgacatcgccaacatgaacgtgtccagcggcgcgcccgtctcggcacgggtgacggggctcagcgcgctcgagaccatctcgctcgccgggaacggcatcgtgggcgccgtcgccgcgtcgtcgctcccggcgctgcgccacgtcaacgtgtcggggaaccagctcggcggcggcctcgacggctgggacttcgcgtcgctgcccggcctcgaggtgctggacgcctacgacaacaacttctcggctccgctcccgctcggcgtcgccgcgctcccgaggctccgctacctggacctcggcggcaactacttcacgggcgagatcccggcggcgtacggcgcgatgcccgcggtggagtacctgtcccttaacggcaacaacctgcaaggccgcatcccaccggagctcggcaacctcaccaccctccgggagctctacctcggttactacaacgtgttcgacggcggcatccccccggcgcttggccggttgcgcagcctcaccgtgctggacgtctccaactgcggcctcacggggcgcgtccccgcggagcttggcgcgctcgcctccatcgagacgctcttcctccacaccaaccaactctccgcgcccatcccgccggagctcggcaacctcacgtcgctcaccgcgctggacctctccaacaatgcgctcaccggcgaggtccctcgctcgctggcgtccctcacctcgctcaagttgctcaacctgttcctgaaccggctccacggaccggtgcccgacttcatcgccgcgctgccgcgtctggagacggtgcagctgttcatgaacaacctcaccggccgcgtccccgcagggctcggcgccaacgccgcgctccggctcgtcgacctgtcctcgaaccgcctcaccggcgtcatcccggaggcgctgtgcgcgtccggcgatctccacacggtcatcctcatgaacaatttcctcttcggcccacccggctcgttcggctcgtgcacgagcctcacccgcgtccggctcggccagaactacctcaacggcagcatccccgccggcctgctgtacctgccgcggctgagcctgctggagctccacaacaacctgctctcaggcgccgtgccgtcgaacccgagcccgagcgcgtccagttcgcagctggcgcagctcaacctgtccaacaacctgctggcggggccgctgccgagcacgctggccaacctcaccgcgctgcagacgctgcttgcgagcaacaaccggatcggcggcgccgtgccgccggaggtcggggagctccggcggctcgtgaagctcgacctcagcggcaacgagctgtcggggccgattcccggggcggtcgggcagtgcggcgagctgacgtatctcgatctcagcaggaacaacctgtccggggcgatcccagaggcgatcgcgggcgtccgggtgctgaattacctcaacctgtcgcggaacgcgctggaggacgcgatcccgacggcgatcggggccatgagcagcctgacggcggcggacttctcgtacaacgacctgtcagggcagctcccggacgggcagctggggtacatgaacgcgacggcgttcgcgggcaacccgaggctgtgcggctctgtggtgagccggccgtgcaactacacgggaggaggcggagtcgcgggcgcggcgacgacgcggctcggcgggctgaagctggtgcttgcgctgggactgctcgcctgctcggttgtgttcgccgtggcggccgtgctccggcggtcgttccgcgtggacgtcggcgcgggcaggtggcggttgacggcgttccacaaggtggactttggcgtggcggaggtgatcgagtgcatgaaggacggcaacgtggtgggccgcggcggcgccggggtggtgtacgcggggcgcacccggtcgggcggcgcgatcgcggtgaagcggctgcaggcccagggcggcgccggcgcgcagcagggcgacgaccgcgggttccgcgcggaggtccggacgctcggcagcatccggcaccggaacatcgtgcgcctgctggccttctgcacgaaccgggaggcgaacgtgctggtgtacgagtacatgggcggcggcagcctcggggtggtgctgcacggcaagggcggcgcgttcctggcgtgggagcggcggtaccggatcgcgctggaggcggcgcgcggctgctacctccaccacgactgcacgcccatgatcgtgcaccgggacgtcaagtccaacaacatcctcctcggcgacaacctggaggcccgcgtcgcggacttcggcctcgccaagttcctccggtgcggcgccacctccgagtccatgtccgccgtcgctggatcctacggctacatcgccccttacgcgtacacgctgcgggtggacgagaagagcgacgtgtacagctacggcgtggtcctgctggagctcatcacgggccgccgcccgggggacttcggggaaggtgtggacatcgtgcagtgggcgaagcgggccacggccggccgccgggaggccgtgccgggagtggaccgccggctcgtcggcggcgcgccggccgacgaggtggcgcacctattcttcgtctccatgctctgcgtgcaggacaatagcgtggagcgccccaccatgcgcgaggtggtgcagatgctcgccgagctcccgcgccacgagtcgtcgccgtccacctcctcctcctcctcgtcgtcgtcggcggtggaaccgccaccaccgcaggccggcgaggagagcagccccgacgacgggaaggagccgccggccaactgctacaagctgttcccggacctgctggcctga

SEQ ID NO: 73 - DNA, 1884 bp, Zea mays
tggtggtggcgcctgccggtcgctgctctgctcgccgcgatcctgccgtcgtccgacgccacgctctcccctgccggcatcaactacgaagtggtggccctgatggccatcaagacggagctggaggacccctacaacgtgctcgacaactgggacattaactccgtcgacccctgcagctggaggatggtcacctgctcctccgacggctacgtctccgccttagggctgcctagccagaccttgtccgggaagctatcacccggcatcggcaacctcaccaggctgcaatctgtgctgttgcagaacaatgggatttccggccctattcccggtacgataggaaggctggggatgctgaagactcttgacatgtcagataaccagctcacggggactatcccaagttcgcttggaaagctcaagaacctcaattatttgaagctgaacaataatagcttgtctggagttctgcctgattcacttgccagcattgatggttttgctctcgtagatctttcgtttaacaatctcagcggtccattacccaagatttctgcaagaacctttatcatagctggaaatccaatgatttgtggtaataattctggagataagtgctcttctgtgtcacttgacccactctcttacccaccagatgatctgaaaactcagccacaacaaggcattggaaagagccatcatattgctacaatatgtggagtaactgttggttcagtagcttttatcgcttttgtagtgggtatacttctttggtggcgtcataggcgaaatcagcagatcttttttgatgttaatgatcaatatgatacagaagtttgtttgggccatctgaagcggtatgctttcaaggagctccgtgcagctactaataattttaactcaaagaacatcttaggtgaaggtggatatggcatagtatacaagggttatttacgcgatggctccgttgttgctgtcaaaaggctgaaggattataatgccgtcggtggggaagttcaattccaaactgaagttgaagtcataagcttggctgttcatcggaatctcctacgtcttattggattctgcactacagagagtgagaggttacttgtttatccatacatgccaaatggaagcgttgcttctcaattgcgggaacatatcaatgccaagccggctctagactggtcaaggagaaagagggtagcgctaggcacagcgaggggtctgctctaccttcacgagcaatgcgacccgaagataatccaccgagacgtgaaggcctccaacgtactcctcgacgagtacttcgaagcgatcgtgggggacttcggactggcgaagctcctggaccacagggagtcccatgtcacgaccgcggtgcgcgggaccgtcgggcatatagcgccggagtacctgtcgactgggcagtcgtcggagaagaccgacgtgtttgggttcggggttctgctagtcgagctggtcaccggacagaaggcgctggatttcggaagagtcgcgaaccagaagggcggagtgctggactgggtcaagaagctccatcaggagaagcagctaggcgtgatggtggacaaggacctgggcagcagctacgacggggtcgagctggaggaaatggtccagctggctctgctatgcacgcagtaccacccgtcccaccggcccagaatgtccgaggtgatcaggatgctggaaggcgagcccgggctcgcggagagatgggaagcgtcgcagggcaacgtggacacgccgaagtccgtctcgtcggagctcctgcctcccaagtacgtggatttcgccgccgcggacgagtcctcgcttggcctggaagccatggagctgtccgggccaaggtga

SEQ ID NO: 74 - DNA, 3072 bp, Zea mays
atgcgcctcctcccgatgctgctgctcctggccctcgccgcgggcgcggctggcgcggcgggcggcagcacggacgcggacgcgctgctcgccgtgaaggcggcggtctccgaccccaccggtgcgctcgcgtcctgggacgccgcctcctccgaccactgcgcgtgggtaggggtcacctgcgcgccccgcggctacggcggaggcgtcgtcgtcgggctcgacgtctccgggctcaacctgtctggcgcgctcccgccggcgctgtcgcggctccgcggcctgcagcgcctctccgtcggcgccaatggcttctacgggctcccgccgtctctcgcgcgcctgcagcttcttgtccacctcaacctctccaacaacgccttcaacggttcctttccgcctgcgctcgcgcggctccgcgccctacgggtgctcgacctctacaacaacaacctcaccagcgccacgctgccgctcgaggtcacgcacatgcccatgctccgccaccttcacctcggcggcaacttcttctccggagagataccgccggagtacggccggtggcccaggctgcagtaccttgcggtctccgggaacgagctctccggcaagataccgcccgagctggggaacctcaccagcctcaaggagctctacattggctactacaacagttactccggtggtcttccgccagagctggggaacttgaccgagctcgtccgcctcgacgccgccaactgtgggctctctggcgaaatcccgccggagctcgggaggctgcagaatctggatacgctcttcttgcaggtgaatggcctcaccggcagcataccgtccgacctgggctacctcaggagcctcagttctttggacctgtcgaacaatgcgctcaccggagagataccggcgagtttctccgagctcaagaacctgacgctgcttaacctgttccggaacaagctgcgcggcgacatccccgacttcgttggcgacctgcccagcctcgaggtgctgcagctgtgggagaataacttcaccggcggtgtgccacgccgcctcggccgcaacggccgcctccaggtgctcgacctctcgtcgaacaagctcaccggcacgctgccgtcggagctctgcgggggcaagctggagactctcatcgctctcggcaacttcttgttcggtgccatcccaggctcactcggccaatgcaagtccttgagccgcgtccgcctcggggagaactacctgaatggctcaattccgaaggggctattcgaattgccgaagctgactcaagttgagttgcaagataacctcctcactggtaatttaccggctgtgatcggtgctgctgctcctaaccttggtgagatcagcctgtccaacaaccagcttacgggcgcattgcccgcatctattgggaacttctccggagttcagaagctgcttctagatcagaacgcgttttctggtgccatacctccggagattgggcggctgcagcagctatccaaggctgaccttagcagcaacaagtttgagggaggtgtgccagcggagattgggaaatgccggcttctcacttacttggacattagcaacaacctctctgggaagatacctccggccatctctggaatgcgaatactgaactacctgaacctatccaggaatcaccttgatggagagatacctccatccattgcaacgatgcagagcttgacagcggttgacttctcgtataacaacttgtctgggcttgtgccatggactggccagttcagctacttcaatgccacatctttcgttggcaacccaggcctgtgtggaccatacctcggtccatgcagtgcaggcattgctgggggcgaccatactgcccatgaccatggtgagctgaccaattcggtcaagctgctcattgtgcttggcttgttgatttgctccattgcatttgctgctgcggcaattctgaaggctcggtcattgaagaaagctagtgaagcgcgagtatggaaactcactgcattccagcgcctggacttcaccagtgatgatgtgctggagtggttgaaagaggagaacattattggcaaaggtggtgctgggattgtgtataagggggcaatgccgaatggtgaacttgtggctgtgaagagactcgcagcaatgggccgtggctcatcacatgatcatgggttctcggcagagatacaaacacttggtagaattcgacaccgtcatattgtgcgcctgctaggcttctgctcaaacagtgagactaacctgctggtctatgagtatatgcccaatggcagccttggggagatgctccatggcaataagggaggacacctgcactgggatacccgatacagcattgctattgaggcagccaagggactttgctacttgcatcatgattgttcgcctttgatacttcaccgtgatgtcaagtcaaataacatacttcttgactccaacttcgaagctcatgtggccgactttggtcttgcgaaattcttgcaggactcaggggcatctgaatgcatgtccgccatagctggctcatatggctacatagcgccatacgcatacacactgaaggtcgatgagaagagcgacgtctatagcttcggcgtcgtgctacttgagctcgtcaccggaaggaagcctgtaggcgagttcggcgacggcgtcgacatcgtccagtgggcgaagctgacgacaggctcgaaaaaagaacaggtgatgaggatcctggacccaaggctctcaaccgttccgctgcacgaggtgacgcatgccttctatgtcgcattgctctgcaccgaagagcagagcgtgcagcgcccgacgatgagggaggtcgtgcagatcctgagcgagtttccaaggccatctagcaagcaaggcgaggaggctccagattccagtgacggctctccttccagtcctttacatccagcaccagttgggtccaatgaaacgccaaccgccgaagcgagagagcagcagcagcaaacaagctctcggtcatcgccaactccagatctcatcagcatctga

SEQ ID NO: 75 - DNA, 1878 bp, Zea mays
atggcgtccacaccgcggctcgctcgcctcgccgcagccgtcgcggcgtggatgctagccgctgctgcttctgctggtgtggaggccggggatccgccgctttcgcccaaggggctcaactacgaagtggcggcgctcatggcggttaagagccggctgcgggacgagaggggggtcatggccctctgggacatcaactccgtcgacccctgcacctggtccatggtcgcctgctccccggacaagttcgtcgtctcgctccagatggccaacaacggcctgtccgggacgctgtcgccgagcatcgggagcctcagccacctccagacaatgtcactacagaataacagaatatcaggtgaaattcctccagagatagggaagctgatcaatctgaatgctcttgacctttccagtaatgagttcattggtgatatcccaagttcattggggcacctgactcgactaaattatctacgccttgataggaataacttgtctgggccgatcccaacagatgttgctaggcttccaggtctcacattccttgacttgtcattcaacaatttaagtggcccagttccaaaaatctatgcacatgattacagtcttgcgggaaatcgattcctttgcaattcctcagttatacatggttgttcagatgtgacagcaatgactaatgggacaatgtcgagacaggtccaaaaggccaagaaccaccatcaattagctttggcaatttctctaagtgtcacctgttccacaatattagttttgttgttcgtgtattggctaagttattgcagatggcgcttgccttttgcttcagctgatcaagatctagaattcgaattgggccatgtgaagcattttgcttttcacgatctgcaaagtgcaacggacaattttaattccaagaatatattaggtcaaggaggttttggtattgtgtataaaggctgtttgagaaatggaactttagtggcagtgaagagattaaaagatcctgatgttaccggtgaagtccagtttcagacagaagttgagttgattggccttgctgtgcacaggaatctcttgcgtttgtatggattttgcatgacctctaaagaacggttgcttgtatatccatatatgccaaatggcagtgttgctgaccgtttgagagattatcgcaatggaaaaccatctcttgattggagtaaacgcatgcggattgctcttggtgctgccagggggttactctaccttcatgaacaatgcaatcctaagatcatccacagggacgtcaaagctgcaaacatattgctcgatggaaatttcgaagcaatcgtcggggattttggattggcgaaacttcttgaccgtcaggaatcgcatgttactactgcagttcggggcactattgggcatattgctcccgagtatctctcaactggacagtcctcggaaaagactgatgtttatgggtttggcattctcctgttggaactgattactggtcctaaaaccttgagcaatggacatggccagtctcagaaaggcatgattctagactgggttagagagctaaaggaggacaagagaccggataagctggtcgacagggatctcagagattcatttgatattcttgagctggagtgttcagttgacgtgatcatccaatgcacgcagacgaaccctatgctgcggcctaagatgtccgaaattctgcacgctcttgaagccaatgtcacgctggcggaaaccagcgtcgagttgaacagggaacctcttccttatggtgtgcctcgcagtttctctgtgaggcatgaggacccccacgattcgtcgtccttcataatagagccaattgagctatctggtcccagatga

SEQ ID NO: 76 - DNA, 1887 bp, Zea mays
atgggggaggttgttgctgcttcctccctggccctggtgctgctcttcttctgctcttgcgggcctgcaagcggccttctctcccccaagggtgtaaactatgaaggtcaatttcaagctctcatgatgatcaagaactacctcaaggatcctcatggtgtactgaagaactgggaccaagactctgtggatccttgcagctggacaatggtcacttgctctccagagaaccttgtcaccggcttagaagcaccaagccagaacctttctggaattctctccccaagtatagggaatctgaccaaccttgagacagttcttctgcagaacaacaacataaacgggttaatcccagcagagattggaaagctaagaaagctcaaaacgcttgatctgtccagcaaccacttctctggagaaatcccaagctctgtgggccaccttgaaagccttcagtatttgaggcttaacaacaacacattgtctggtgccttcccttcatcatcaactaatttgtcacaccttattttcctggatctgtcatacaataatttgagtggtccaatcccagggtccctgacaaggactttcaacattgtagggaatccactgatctgtgcagcaaccatggaacaagattgttatgggtctttacctatgccaatgtcttacggactgaataacacacagggaactgtgattcctgcaaaagctaagagccataaagttgcaattgcatttggtgctacaactgcctgcatcagccttctgttccttgccgttggttcactattctggtggaggtgtaggcgaaaccggaagactcttttcaacgttgatgatcatcagcacatagagaacggcaacctcggaaatatgaagcggtttcaattcagagagctccaggctgcaacagaaaacttcagcagcaagaacatattaggaaaaggcgggtttggtattgtttaccgggggcagcttccagatggaagtcttgtagccgtcaagaggctcaaagatggtaatgctgcaggcggggaagcacagtttcagactgaagtcgagatgatcagcttagcagtgcacaggaacctcctcagactctatgggttctgcatgactgccagtgagaggctactggtctatccgtacatgtcgaatgggagtgtcgcgttgcgcctgaaagggaagccaccactggactggatcaccagaaagaggatagcacttggggcagcacgaggtctactttatctgcacgagcagtgtgatcccaagatcatccacagagacgttaaggcagcaaacatactgctagatgactgttgtgaagcaattgtcggggactttgggcttgcaaagctcctagaccaccgtgaatcgcatgtcaccacagctgtgcgcggaactgttggccacatcgctcccgagtacctctcgactggccagtcatctgagaaaacagatgtctttggttttggaattctgctgctggagctgatcactggtcagactgcactggagtttgggaagtcatcaaatcagaagggagccatgttagactgggtgaagaagatgcaccaagagaagcagctggacatacttgtcgacaagggcctggggagcaaatatgaccgcattgagctggaggagatggtgcaagtagcactgctatgtactcagttcctccctggtcacaggcccaagatgtcagaggtggtccggatgctggaaggcgatggacttgcagagcggtgggaggcgttacaacacactgagtcacacaaattcaaggtgcctgagttctccttcagccgctgccactctgacctgacggacgactcgtcactgttggtgcaagcagtggagctttctgggccaagatga

SEQ ID NO: 77 - DNA, 3111 bp, Zea mays
ccaatgccaatgcgcctcctcctcctcctcaccttcctcgccaccgccgccgcggtggcgggtgctgccggtggcgcggccgcggctggctcggatgcggacgcgctgctggcggcgaaggcggtgctgtcggacccggccggcgcgctcgcgtcctggacgaacgccaccagcaccggcgcctgcgcgtggtccggcgtgacgtgcaacgcgcgcgccgcggtcatcggcctcgacctctccggccgcaacctctcgggcccggtgcccacggcgctgtcccgcctcgcgcacctcgcgcgcctcgacctcgccgcgaacgcgctctgcggccccatcccggcgccgctgtcccggctccagtccctcacccacctcaacctctccaacaacgtgctcaacggcaccttcccgccgccgctcgcgcgcctgcgggcgctccgcgtgctcgacctctacaacaacaacctcaccggcccgctcccgctcgcggtcgtgggcctgccggtgctccgccacctccacctcggcggcaacttcttctccggcgagatcccgcccgagtacggccgctggcggaggctgcagtacctcgccgtctccgggaacgagctgtcggggaggattcctccggagctcggcggcctcaccaccctcagggagctctacattggctactacaacagctactccagcggcctacccccggagctcggcaacatgacggatctcgtccgcctcgacgccgccaactgcgggctctccggcgagattccgccggagctcgggaacctcgccaacctcgacacgctcttcctgcaggtgaacgggctcgccggcgccatcccgccggagctgggccggctcaagagcctcagctcgctcgacctgtccaacaacgcgctcaccggcgagatcccagcgagcttcgcgtcgctcaggaacctcactttgctcaacctcttccgtaacaagctgagaggcagcatcccggagctcgtcggcgacctgcccagcctcgaggtgctgcagctctggaacaacttcaccggcggcatcccgcgccggctcggccgcaatggacggctccagctggtcgacctctcgtccaacaggctcaccggcaccctcccgccggagctgtgcgccgggggcaagctggagacgctcatcgcgctaggcaacttcctctttggctcaatccctgaaccactggggaaatgcgaggcactctcccgcatccgcctcggcgagaactacctgaacggttccatcccggaaggtctctttgagctcccgaatctgacgcaggttgagctgcaggacaacctcctgtccggcggcttcccggcggtttccagcaccggtgcgccgaatctgggggcgatcactctctccaacaaccagctcaccggcgcactgccggcgtccatcgggaagttctcaggtttgcaaaaactgcttcttgaccagaatgcattcaccggcgcagtaccgccggagatcgggcggctgcagcagctgtctaaggctgacttgagcggcaacacgcttgacggcggtgtgccgccagagatcgggaagtgccgattgctcacctacctggacctcagccggaacaacctgtccggggagataccgccggccatctccggcatgcgaatactcaactacctgaacctgtcccggaaccacctcggtggagagataccggcaaccattgctgcgatgcagagcctcacggctgtggatttctcctacaacaacctgtccgggctcgtgccagcgactgggcagtttagctacttcaatgccacatccttcgtcggcaacccggggttgtgtgggccgtaccttggaccatgccattctggcggcgccggcacgggccatgatgcacacacctatggcggcatgtccaataccttcaagctgctaatcgtcctcggcttacttgtctgctccattgcgtttgctgccatggcgatcttgaaggcccggtcactgaagaaggccagcgaggcacgcgcttggaggctcaccgcgttccagcgcctcgagttcacctgcgacgacgtgctagacagtctgaaggaggagaacatcatcggcaaaggtggagccgggatcgtgtacaaggggacgatgccggacggtgagcatgtcgcagtgaagcggctttcgtcgatgagccgtggctcgtcgcacgaccacgggttctctgcagagatacaaaccctcgggaggatccggcaccgctacatcgtgaggctgctcggcttctgctcgaacaacgagacgaatctcctggtatacgagttcatgcccaacgggagcggggagctgctccatggcaagaaaggcgggcatctccactgggacactcgctacaagatcgccgtcgaggccgccaaggggctcagctacctgcaccacgattgctcgccgccgatcctgcaccgcgatgttaaatcgaacaacatcctgcttgattccgatttcgaagcacacgttgctgatttcgggctcgccaagttcttgcaggactctggcgcatcacagtgtatgtctgccattgcaggctcctatggctatattgccccatacgcatacaccctcaaggtggacgagaagagcgacgtgtacagcttcggcgtggtgctcctggagctggtcacgggaaagaagccggtaggcgagttcggggacggcgtggacatcgtccactgggtcaggtcgacgacggcgggcgcgagcaaggagcaggtggtcaaggtcatggaccccaggctgtcgagcgtgccggtgcacgaggtggcgcacgtgttctgcgtcgcgctcctctgcgtggaggagcagagcgtgcagcgccccacgatgcgggaggtggtgcagatgctcggcgagctccccaagccagccgctgccgctgccgctgcagctgcagggcaaggagacgaggttcccggcggcggcggcggcgacgacgaatgttccgccgcaccgtcgggtgctccggcagcggatggatctgttgaagcggcgcatggcgaagccaccaaagaaccgagctcgcagtcttcgccgaccactgatctcatcagcatctga

SEQ ID NO: 78 - DNA, 3195 bp, Zea mays
atggccgctcgaaccttgctgctcgtgctgctcttgcttctgctcggtgacgccacctcggcttccgtcagcggccagcgcgaagcgttgatgaagttcaaagcggccgtgacggccgacccgggcggcctgctgcgcggctggtccccggcgtccggggaccactgccgctggccgggcgtgtcgtgcggcgcttccggggaggtggtcgcgctcaacgtcacctcctcgcccgggcgcgcgctcgcgggcgcgctgtctccggccgtcgcggcgctgcgggagctccgcgtgctcgctctcccgtcccacgcgctctcgggcccgctcccgcccgcgatctggacgctgcgccgcctccgcgtcctcgacctctccggcaatcgcctccagggcgggatccccgcagtgctcgtttgcgtctccctccagacgctggaccttgcctacaaccagctcaacggctccgtgcccgcggccctcggtgcgctccctgtgctacggcggctgtcacttgcctgcaaccgcttcggtggcgccatccctgacgagctcggtggcgccggttgccgcaacctgcagttcctcgatgtctctgggaacatgctcgtcggtggcataccccggagcctggggaattgtactgagctgcaggcgctgttattgtcctcgaacaatctggatgacatcatcccgccggagattggtcggctcaagaacctgcgtgcattagatgtgtccaggaacagtttgagtgggcctgtgccagcggagcttggtggttgcattcagctgtcagtgcttgttctgtccaatccttatgcacccactgctggttctgattcttctgattatggtgagctcgatgacttcaactacttccaaggagggattccggatactatcgctacactgccaaagctgaggatgttgtgggcgccaagagccacattggagggagagttgccgggtaattggagttcttgccagagcttggagatgataaatttgggggagaatctgttctctggtgggattcctaaggggctggtggaatgtgagaatttgaagttcctgaatttgagcatgaacaagtttacaggttcagttgattcttcgctgccagtaccttgcatggacgtgtttgatgtcagtggaaatcagctgtctggctcgttgccagtatttatgtcaaaaaagaattgtctttcatcccaggccccacgggatgacttggtgtcggagtattcttccttcttcacatatcaagcgcttgctggctttatgtcatccccatcacccttggatgcacatttgacaagctatcatagtttttccaggaacaattttactggtccagttacatccttacctcttgctactgaaaagttggggatgcaggggtcctatgcattcttggctgatgggaatcatcttggtggtcagcttcaacctagtctatttgacaagtgcaacagctcaaggggcctcgtcgtggaaatcagtaacaacttgataagtggagctattcccacagacattggctcgctttgcagttctcttcttgttcttggtgttgctggtaatcagctttcaggtatgataccatcaagtatcggggagttaagttaccttatcagcttggatttgagtaggaatcgccttggtggtgtaattcctacttctgtgaagaacttgctgcatttacagcgcctctctttggctcagaaccttctgaatggcacaattccacctgatattaatcagttgcatgctctcaaggttttggacctgtcatcaaacctcctcatggggatgatccctgatgcccttgctgacttgagaaatctcactgctctcctccttgataacaataaacttactgggaagattccttcaggatttgctaactcggcatcccttaccacgtttaatgtgtcattcaacaatttgtctggtccagtgccaacgaatggtaatacggttagatgtgacagtgttattgggaatcctttgctgcaatcttgtcatgtgtacactctggctgtgccatcagctgctcagcagggtcgaggtttgaattcgaatgacagcaatgatacaacaccttcaaactcacaaaacgaaggagcgaacaattcatttaatgcaattgaaattgcttcaataacttctgcaacagccatcgtttccatcctccttgcactgattgcactcttcatatacacaaggaagtgcgcgccccggatgtcagctcggtcttctggaaggagagaagttacactcttccaagatattggtgtcccaatcacttatgagactgttgttcgagccactggaagtttcaatgcaagcaattgcatcggaagtggaggctttggagccacttacaaggctgaaattgcacctggagtgttggtagctattaagagactctctgtcgggagatttcagggagcccaacagtttgacgctgagataaaaactctagggagattaagacatccaaatcttgttaccttggtaggttaccatctaggcgagtctgaaatgtttctcatatataactacttgtctggaggaaaccttgagaggtttatacaggagagatcgaagagaccggtagactggaaaatgctgcacaagattgcattggacgttgccaaagcacttgcttatctgcatgatacctgtgttcctcgcatccttcaccgggacgtgaagccgagcaatattttgttggacaccaactatactgcttacctctcggactttggactggcgagactcttgggaaattcagaaacacatgcaaccactggtgtagctggaacatttggatatgttgctccagaatatgctatgacttgtcgtgtttcagataaagctgatgtgtatagctatggtgttgtcctgatggagctaatctcagacaagaaggctttggacccgtccttttccccatatggtaatgggttcaacatagttgcttgggcttgcatgctgcttcgtcaaggccgtgctcgggaattctttattgatggtctgtgggatgttggcccgcatgatgacttggtagaaacattgcatttagcagtgatatgcactgctgattcactctctatacggccaactatgaagcaggtcgttcagagattaaagcagctacagcctccaattcgtgaacatcgatag

SEQ ID NO: 79 - DNA, 3102 bp, Zea mays
atggcgatggcgccctccacggcggccgcatccgcccttctccccgtcctcctcctcatcgccaccgccacccagtgcaccgcagccgattcattctcttccccggacgctgccgccctcctcaacctctctgcggcggtagcagacccctcgggctacctctccacgcactggactccggacaccgcggtctgctcgtggccacgcgtgtcctgcgacgccaccgacacacgagtcatctccctcgacctctccggcctcaacctatctggccccatccccgccgccgcgctctcctctttcccgtacctccaatcgctcaacctctccaacaacatactcaactccaccgccttccccgacgagatcatcgcgtcgctcaagagccttcgcgttctcgacctctacaataacaacctcaccggttcgctgccggcagcgctccccaacctcaccgacctcgtccacgtccacctcggcggcaatttcttctccggcagcatcccgaggtcctacggccagtggagccgcatccggtacctggccctctccgggaacgagctcaccggcgagataccggaggagctcggcaacctgacgacgttgagggagctgtacctcggctactacaacaacttcaccggcggtataccacccgagctcgggaggctgcgggcgctcgtccggctcgacatggctaactgcggcatctccgaggagatcccgccggaactggcgaacttgacgtcgctcgacactctgtttcttcagatcaacgctctgtctgggaggctcccgacggagataggcgcaatggggtcgctcaaatcgctcgacctgtcgaacaacttgttcgtcggggagatccccgcgagcttcgcgttgctcaagaacctgaccctgctgaacctcttccggaatcgcctcgccggtgagattcccgagttcatcggcgacttgccgaacctcgaggttctgcagctgtgggagaacaacttcacaggcgggatacccacgaacctcggcgtggcggcgaccaggctgaggatcgttgacgtgagcacgaacaagctcaccggcgttctgccatccgagctgtgcgccggccagcggctggagacgttcatcgctctgggaaattcgctgttcggcgacgttccggacgggctcgcggggtgcccgtcgctgacgaggattcggctgggagagaattttctcaacgggacgatacctgcaaagctgttcacgttgccgaacctgacgcaggtagagctgcacaacaatttgctctccggcgagctccggctggacggagggaaggtgtcttcttcgatcggagagctgagtctgttcaacaaccgactgaccggccaggtgcctaccgggatcggtggactcctgggattacagaagctgctgctcgccgggaacatgttgtccggcgagctcccgccggaggtcgggaagcttcagcagctctcgaaggcggacctttctgggaacctgctctccggagcggtacccccggcgatcggcagatgccgtctgctcaccttcctcgatatctcgagcaacaagctctccggcagcatcccgccggagctcggcaacctccgcatcctcaactacctcaacgtttcccacaacgcgctccaaggggagattccgcctgccatcgccggaatgcagagcctgacagccgtggacttctcctacaacaacctctcgggcgaggtcccgtccaccggtcagtttggctacttcaacgccacttccttcgcaggcaacgctggcctctgcggggcgttcctgtccccgtgccgctccgtcggcgtggcgacttcggccctggggtccctctcttcgacgtccaaactcctgctcgtgctcggcctcctcgcgctgtccgtcgtcttcggcgcggccgtgctgaaggcgcggtcgctgaagcggtccgccgaggcgcgcgcgtggcggctgacggcgttccagcggctggacttcgccgtggacgacgtgctggactgcctcaaggaggagaacgtgatcggcaagggcgggtccgggatcgtgtacaagggcgcgatgccgggcggcgccgtggtggccgtgaagcggctgccggccatcgggcgcgcgggcgcggcgcacgacgactacgggttctcggcggagatacagacgctggggcgcatcaggcaccgccacatcgtgcggctgctcggcttcgcggccaaccgggagaccaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcgggctcgccaagttcctccggggcaacgccggcggttcggagtgcatgtccgctatcgccggctcgtacggctacattgctccttttcgtcgcgtttgtcgttttaatggatcatcattgggaattgttggctgcgatctcatgtggcctcgcttcctctgtcccccctccccagagtacgcctacacgctgaaggtggacgagaagagcgatgtgtacagcttcggcgtggtgctgctggagctcatcgccgggcgcaagcccgtcggggagttcggcgacggcgtggacatcgtgcactgggtgcggacggtgaccgggtcgagcaaggagggcgtgatgaagatcgccgacccacggctctcgacggtgcctctgtacgagctaacccacgtcttctacgtcgccatgctgtgcgtggcggagcagagcgtggagcgccccacgatgcgcgaggtcgtgcagatactggccgacatgcccggctcgacatccacgtccatagacgtgccccttgtcatcgagccgaaggaggaggacgggggcccggagaaaaagaagaagcagcagcagcagcagcaggaagggccacacgactcgccgccgcagcaggatcttcttagtatctag

SEQ ID NO: 80 - DNA, 3090 bp, Zea mays
atgcgcctcctcccgctgctcctgctcctgtccctcgccgctgtcgcggccggcacggacgcggacgcggacgcgctgctggccgcgaaggccgcgctctccgaccccactggggcgctcgcgtcctgggacgcggcctcctccgaccattgcgcgtgggtgggggtcacctgcgcgccccgcggctccggcggaggcgtcgtcgtcgggctcgacgtctccgggctcaacctgtccggcgcgctcccgccggcgctgtcgcggctccgcggcctgcagcgcctctccgtcgccgccaacggcttctacgggcccatcccgccgtccctcgcgcgcctgcagctcctcgtccacctcaacctctccaacaacgccttcaacggcttcccgcctgcgctcgcgcggctccgcgcactccgggtgctcgacctctacaacaacaacctcaccagcgccacgttgccgctcgaggtcacgcacatgcccatgctccgtcacctgcacctcggcggcaacttcttctccggggagataccgccggagtacggccggtggcctaggctgcagtaccttgcggtctccgggaacgagctctccggcaagataccgcccgagctggggaacctcaccagcctcagggagctctacattggctactacaacagttacaccggtggccttccgccggagctggggaacctgaccgagctcgtccgcctcgacgccgccaactgtgggctctccggcgaaatcccgccggagctcgggaggctgcagaatctggacacgctcttcttgcaggtgaatggcctcaccggcagcataccgtcggagctgggctacctcaggagcctcagttctttggacctgtcgaacaatgcgctcaccggtgagatacctgcgagtttctccgagctcaagaacctgacgctgcttaacctgttccggaacaagttgcgcggcgacatccccggcttcgtcggcgacctgcccagcctcgaggtgctgcagctgtgggagaataacttcaccggcggtgtgccacgccgcctcggccgcaacggccgcctccagctgctcgacctctcgtcgaacaagctcaccggcacgcttccgccggagctctgtgcggggggcaagctgcagacgctaatcgccctcggcaacttcttgttcggtgccatcccagactcactcggccagtgcaagtccttgagccgtgtccgtctcggggagaactacctgaatggctcaattccgggtctattcgaattgccgaagctgactcaagttgagttgcaagataacctcctcactggcaatttcccggctgtgatcggtgctgcggctcctaaccttggtgagagcctgtccaacaaccagcttacgggtgcattgcctgcatctcttgggaacttctctggtgttcagaagttgctgcttgatcagaacgcgttctctggtgccatacctccggagattgggcggctgcagcagctctccaaggctgaccttagcagcaacaagtttgagggaggtgtgccaccggaggtcgggaaatgccggcttctcacttacttggacatgagccaaaacaacctctctgggaagatacctccggccatctctggaatgcgaatactgaacctgaacctgtccaggaaccatcttgatggagagatacctccatccattgcaaccatgcagagcttgacggcggtggacttctcgtataacaacttgtctgggcttgtgccagggactggccagttcagctacttcaatgccacatcttttgttggcaatccaggcctgtgtggaccatacctcggtccatgtggtgcaggcataggtggcgccgaccactctgtccatggccatggctggttgaccaatacggtcaagctgctcattgtccttggcttgttgatctgctccattgcattcgctgtggcggcgattctgaaggctcggtcattgaagaaagctagtgaagctcgagtatggaaactcactgcattccagcgcctagacttcaccagcgatgatgtgctggattgcttgaaagaggagcacattattggcaaaggtggtgctgggattgtgtataaggggatgccgaatggtgaacttgtggctgtgaagagactcccagcaatgggccgtggctcatcacatgatcatgggttctcggcagagatacaaacacttggtagaattcgacaccgtcatattgtgcgcctgctaggcttctgctcaaacaatgagactaacctgttggtttatgagtatatgcccaatggcagccttggggagatgctccatggcaagaagggagggcacctccactgggatacccgatacagcattgctattgaggcagccaaggggctttgctacttgcaccatgactgttcacctttgatacttcaccgggatgtcaagtcaaataatatacttcttgactccaactttgaagctcatgtggccgactttgggctagcaaaattcttgcaggactcgggggcatctgaatgcatgtctgccatcgctggctcatatggctacatagcgccagaatacgcatacacattgaaggtggacgagaagagtgatgtctacagcttcggcgtggtgcttctggagcttgtcacaggaaggaagcccgtaggcgagttcggcgacggcgtcgacatcgtccagtgggcgaagatgacgacgaactcaaacaaggaacaagtgatgaaggtcctggacccaaggctctcgaccgtcccgctgcacgaggtgacgcacgtcttctacgtcgcgttgctgtgcaccgaggagcaaagcgtgcagcgcccgacgatgagggaggtggtgcagatcctgagcgagcttccaaaaccgccatctaccaagcagggagaggagaattctaccaagcaaggagaggaggttccgaattccggcgacggctctgcgcccagccctctacactcagcaccagttgggaccaacgaagcaccagccgtcgaagcgagagaccaccagcagcagacaagctctccgtcgtcgccaccgcctccagatctcatcagcatctga

SEQ ID NO: 81 - DNA, 1086 bp, Zea mays
gttatacatggttgttcatatgtgacagcaatgactaatgatcaagatctagaattcgaattgtgccatgtgaagcatttcgcatttcacgatctgcaaagtgcaacggacaattttaattccaagaatatattaggtcaaggaggttttggaattgtgtataaaggctgtttgagaaatggaactttagtggtagtgaagagattaaaagatcctgatgttattggtgaagtccaatttcaaacagaagttgagttgattggccttgctgtgcacaggaatctcttgcgtttgtatggattttgcatgacctctaaagaacgattgcttgtatatccatatatgccaaatggcagtgttgctgaccgcttgagagattatcgcaatggaaaaccatctcttgattggagtaaacgcatgcggattgctcttggcactgccagggggttactctaccttcatgaacaatgcaatcctaagatcatccacagggacgtcaaagctgcaaacatattgctcgatggaaatttcgaagcaatcgtcggggattttggattagcaaaacttcttgaccgtcaggaatcacatgttaccactgcaattcggggcactattgggcatattgctcctgagtatctctcaactggacagtcctcggaaaagactgatgtttatgggattggcattctcctattggaactgattactggtcctaagaccttgagcaatggacatggccagtctcagaaaggcatgattctagactgggttagagagctaaaggaggacaagagactggataagctggtcgacagggatctcagagattcatttgatattcttgagctggagtgttcagttgacgtgatcatccaatgcacacagacgaaccctatgctgtggcctaagttgtctgaaattctacacgctcttgaagccaatgtcacgctggcggaaaccagcgtcgaattgaacagggaacctcttccttatggcgtgccttgcagttcctctatgaggcatgaggaccctcacgattcatcgtccttcataatagagccaatcgagctatctggtcccagatga

SEQ ID NO: 82 - DNA, 2970 bp, Zea mays
ctcgacctcgtcgtcctcctcctcctgcccatcttccttctctcatcgtcttcctgcctcgtcctcgccattccaacgctagccagccaggctgccaccctgctctccctcaaggactctttctcgcctccgctcccgccgcagctgcgcagctggaccctcgccaactatgcctcgctctgctcctcatggcccggcgtcgcctgcagcaaccgcaccgtcgtctcgctcgacatctccggctacaacctctccggcacgctgccccccgctatcgccgacctcgctggcctccgtttcttctccgccgccgccaactccctctccggagacattccgcccgccatcgccgccctccgcgacctccgccacctcaacctctccaacaaccagttcaacggcaccctggacgccctcgacttctccgcgatgcacagcctccaggtgctcgacctctacgacaacgacctcgccggcgcacttcccaccctcctccccgcggccgcgggcctccgccacctcgacctcggcgggaacttcttctccggcaccattcctcccagcttcggccgcttccccgccatccagttcctctccctcgccggcaacagcctctccggggacatcccgcccgacctcgccaacctctccacgctgcgccacctcttcctcggctacttcaaccgcttcgacggcggcatcccggcggagctcggcaggctcaccagcctcgtccacctcgacctcgccaactgcggcctgcagggccccatcccggcctcgctcggcgacctcaccgggctggacacgctctacctgcagacgaaccagctgaacggcaccatcccgccgtcgctgggcaacctcaccggccttaggttcctcgacgtctccaacaacgcgctcggggagatccctcccgagctcgccgcgctcagggaactcaggctgctgaacatgttcatcaaccggttccgcggcggcgtcccggacttcctgggcgacctccgctccctgcaggtcctcaagctgtggcagaacaacttcacgggcgcccccgcggcgctcggccgcgccgcgccgctccgggaggtggacctgtccacgaaccggctgacgggggaggtgccccgctggctgtgcgcgcgcgggcagctggagatcctcatcctcctcgacaacttcctcttcgggccggtgccggaggggctgggcgcctgcccgacgctcacgcgggtgaggctgggccagaactacctcacggggccgctcccgcgcggcttcctctacctgccggcgctcaccaccgtggagctgcagggcaactacctgacgggacggctggaggaggacggcagcggcagcagcaggctgtcgctgctgaacctgtcgagcaaccgcttcaacggatcgctgccggcatccatgggcaacttctcgtggctgcagacgctcctcctcggtggcaaccagctgggcgggcagatcccgcggcaggtcgggcgcctgaagcggctgctgaagctggacctgagcggcaacaagctgacgggggcggtgcccggcgaggtgggcgagtgcacgtcgctgacgtacctggacctgagcggcaaccgtctgtccggcgcgatccccgtgcggctggtgcagatcaaggtgctcaactacctgaacgtgtcgtggaacatgctgagcggcagcatcccgcgggagctgggcggcatgaagagcctgaccgccgccgacttctcgcacaacgagctgtccgggcgcgtgccggagagcgggcagttcgcctacttgaacgggtcgtcgttcgtgggcaacccggggctggtggtggtgaatccgaagcagcaggtgatgggaggagggccggggatcctcggcggcgcggggacgcaggatgaacgtggctcttcttcgtcgtcggcggtgatggggcgcctgaagctgctgcttgcggcggtgggcctccttgggttctccgtggcgttcgcggcggctgccgtggcgacgacgcgttccgccgccatgctccggcggcggcgtcggtcttcgtcgtggcggtggcgcatgacggcgttccagcaggtgtctttcgggtgcgaggacgtggtgcggtgcgtgaaggagaactgcgtggtggggcgcggcggggccggggtggtgtaccgcgggacgatgcccggcggggagtgcgtggcggtgaagcggatcgtgtcggcggagggcggcgggttccaggcggaggtggagacgctgggtgggatccggcaccggcacatcgtgcggctgctggccttctgctcggggcccgaggcgaagctgctggtgtacgagtacatggtgaacggcagcctcggggaggcgctgcaccgcgctgatgatggcggcggcggtgtggtgctgtcgtgggcgtcgcgtctccgcgtggcgacggaggctgccaaggggctgtgctacctgcaccacgactgctcgccgccgatcctgcaccgggacgtcaagtccaacaacatcctgctggacgcgcgcatggaggcccacgtggcggacttcgggctggccaagttcctgggcggcagcggcgcctccgagtgcatgtccgccgtcgcaggatcatacggctacatcgcaccatacgcgtacacgctcaaggtggacgagaagagtgacgtgtacagcttcggcgtggtcctgctggagctcatcacggggctgaagccggtgggggagcacctcggcgacgacgcggtggacctggtgcagtgggcgcgcgcccggagctctgcagggggcggcgtcctggcgctgctggaccctcgcctcggcggcgacgtcccggtggcggaggcggcgcatgtgctgttcgtgtcgatgctatgcgtgcaggagcacagcgtggagcgccccaccatgcgcgaggtcgtccagatgctgcagcaggcacggcaccagcctagctag

SEQ ID NO: 83 - DNA, 1932 bp, Zea mays
gggtggtgctgggtggcgctcgctgctgtgctcgccttcatcctgccgccgtccaacgccacgctctcccctgccggcatcaactacgaagtggctctgatggccatcaagacggagctggaggacccctacaacgtgctcgacaactgggacatcaactccgtcccctgcagctggaggatggtcacgtgctcctccgacggctacgtctccgccttgtacgtcacgctcccttgttcatgcccattctcaagagcaccggcggtggctcgatcttctcacatgcgttccttcgtttgcagaggactgcctagccagagcttgtctgggaagttatcacctggcatcggtaacctcaccaggctgcaatctctgttgcagaacaacgtgatttctggacctattcccagtacgataggaaggctggggatgctaaagactcttgacatgtcagataaccagctcacggggagtatcccaggctcgcttggaaatctgaagaacctcaattataagttgaacaataatagcttgtctggagttctgcctgattcaattgccagcattgatggttttgctctcgatctttcgtttaacaatctcagtggcccattacccaagatttctgcaagaacctttatagctggaaatccaatgatttgtggtaataaatctggagatagctgctcttctgtgtcacttgacccactctcttacccaccagatgatctgaaacagccacaacaaggtattggaaggagccatcatattgctacaatatgtggagcaactgttggttcagtagcttttgtcgctgttgtagttggtatgcttctttggtggcgtcataggcgaaatcagcagatcttttttgatgttaaccaatatgatccagaagtttgtttgggtcatctaaagcggtatgctttcaaggagctccgtgcagctactaataattttaactcaaagaacatcttaggtgaaggtggatatggcatagtatacaagggttatttgcgtgatggctctgttgttgctgttaaaaggctgaaggattataatgccgtcggtggggaagttcaattccaaactgaagttgaagtcataagcttggctgtgcatcggaatctcctccgtcttattggattctgcactacagagagcgagaggttacttgtttatccatatatgccaaatggaagtgttgcttctcaattgcggcatataaacggcaagccagctctagactggccaaggagaaagaggatagcgctaggcacggcacggggcctgctctaccttcacgagcaatgcgacccgaagataatccaccgggacgtaaaggcttccaacgtgcttctcgacgagtacttcgaagcgatcgtgggagacttcgggctggcgaaactcctggaccacagggagtcccacgtcacgaccgcggtgcgcgggaccgtcggacacatcgcgccggagtacctgtcgaccggccagtcgtcggagaagaccgacgtgtttgggttcggggttctgttagtcgagctgattactgggcagaaggcgctggatttcggaagggtggcgaaccagaagggtggagtgctcgactgggtgaagaaactccaccaagaaaagcagctaggcacgatggtggacaaggacctgggcagcagctacgacagggtggagctggaggagatggtccaggtgtccttgctgtgcacgcagtaccacccgtcgcaccggcccaggatgtccgaggtgatcaggatgctggagggggacgggctcgcggagagatgggaggcgtcgcagaacgtggacaccccggagtccgtctcgtcggagctcctgctccagaagtacatggacttcgcagcggacgagtgctcgctcggcctggaagccatggagctctccggcccgaggtga

SEQ ID NO: 84 - DNA, 3156 bp, Zea mays
atgtcgctccccaccagacttgtgctgctgcttccgttgctgctgcttcatgggatcctaccagcaccaacttcggcgtcagcagcaccgttgagaagtgagacggaccgggaagccttgctggagctgaaggccgtcctaggccagcgatcaagcaggctgtcgtcctggaacagtagcgctagcctgtgcctgtggccaggtgtgacatgcagccacaggcacggaggcagggtctcagcactccatctcagctctgccggccttgccggcaccatacctgcgtcggtgggcaacttgacgttcctgacgagcatcgacctcagccaaaacaagctggaaggcgaaatccccgcggcagttggccgcctgcaccggctgcgataccttgacatgtcaaacaactcgctgcagagcgagatcccggctggcctgaggaactgcagcagccttgtgagcatcaggcttggtgggaaccagctgacgggaggagtccctggttggcttggaggcctgccaaagctccaaggcgtgctgctggggccgaacaatctcacggggctgatcccccggtcgctcgccaatctcacttcttccctgagggaaatcaaccttgagaccaaccacctggctcgagggcaccatccccgagggcttcggaaaccgtatctcaggcgccatccccgcggacctctcctcaacgtgtcttcgctgatcacgctcgcggtgtccgacaacacgatgcacggtacgctgccgtctgacatgggggctggcctacccatgatcagatatctcctcctgagcaggaacctcttcgctggaggagttccgccttcacttggcaatgcaaccatgctccatgtgatagatctcagcgtgaacagcctcaccggcaccataccgccaggggtaggaaggctttgtccagataccttagctttcgacgacaacatgcttgaggcaagcagcgcccaggactgggagttcatcacatccttcacgaactgcacccgcggcctgcgtctcctcagcctccagtacaacttgcttggcggtgagctcccgagttccgtcgccaatctttcgtcccagctccagttgctgtacctctcagcgaatgagatttctggtaagataccactcgacattggcaatctagctggcctacaagcactgaagctagactacaaccagttctctgggtctcttcctactagcatcggaaggctatcaaccctgaaactcttgcagttctcgaacaacaacctatcaggaagcctgccttcttcgatcggcaacctaacacaactgcaaatattgctcgcatataagaacgcctttgtagggccccttccatccagccttggcaacttgcaacagctaaatggtgttggcttgtctaataacaagtttactggccctttgcctaaagagattttcaacctgtcgtccttgacagatgatctttatttgtcctacaattacttcgttggttctctcccaccagaagttggaagtcttacaaaccttgtacatctgtacatctccgggaacaatttatctggccccttgcctgattcactaggcaactgcttaagcatgatggagcttcgattggacggtaactccttcagtggtgccattcccacatccttcagttcaatgcgtggcttggtactgctaaatttaacagacaacatgctctcaggaaaaattcctcaagaactgtcccgcataagtggtttagaagaactgtatcttgcccacaacaacctttcaggaccaatccctcatacctttggaaatatgacctcattgaaccatctagacctgtctttcaaccaactcagtggccaaatcccagtacagggtgtgtttactaatgtgacgggcttctcttttgctggtaatgatgaactctgcggaggtgtccaggagttgcatttgcctgcttgcgcaaacaaacctttgtggcacagtcggagaaatcaccatatcattcttaaagtagtgattccagttgcaggtgcactgctgttattcatgaccttagcagttcttgttcgaaccttgcaaaagaaatcaaaagcacaatcagaagctgcaccggtgacagtagagggtgctctccaattgatggacgacgtgtatccaagagtttcctatgcagatttagtacgtggaacagatggattttctctaagcaaccggattggtacagggaggtatggatcggtgtacaaggggagcttggtgatcaataacgcaacaactatcgttgctgtgaaggtttttgatctccaacagtcaggctctttgagaagtttcatgtcagagtgtgaggcacttcgtaaggtccggcatcgtaacttggttagtgtcatcacttgttgctctggttatgactccaaccaaaacaacttcaaagccattgtgctagagtacatgactaatgggagccttgacaagtggatacatccagatcaaggtggacagtctacagatccagttggtctgacattaatgcagagattgaacattgctattgacacttgtgacgcgatggactacctgcataatagttgccagccaccgatagttcactgcgacttgaagccaagcaacatccttctcaatgaagactttggtgctcttgttggggactttggaattgcaaagattcttagagactcgacaggcgacccctcgaacatgaactccagaagctccactggcaccgggataaggggaacaatcggatatgttgctccagaatatggggaaggtcaccaagtttccccatgcggagatgtttacagttttggaattctactcctggagttgtttactggaaaggctcctaccaatgacatgtttgcagatggcctgagcttgcagggctacgtccaggctgcattcccagatcatctggtggacattgtagatcctgctattgtagcagcagaagaaaactatgcacatgatgtgcacagcggaaccagcaacggtccacggggacaaaacaacagtgtcatggtatctgttactgggctggcactgttgtgtactaagcaggcaccagcagaaaggatatccatgagaaacgcagccaccgagctgcggaagataagggcccacttcatccgccagtaa

SEQ ID NO: 85 - DNA, 3120 bp, Zea mays
atgaggccttcgccacctctgctcctgctcgtgctcctgcatttcgcgctcctgtccaccaacgccaatgggaacggcgacctgcgcggcgacgcgatggcgctgctggccctcaaggccgcgctcagctgccgcccgggcgcgctgcggtcgtggtcggtggccaatgccgggtccgtgtgcgcgtgggcgggcgtccgctgcgcggccgggcgcgtggtcgccgtcgacatcgccaacatgaacgtgtcggacggcacgcccgtgtcggcccgggtgacggggctcggcgcgctcgagaccatctcgctggccgggaacggcatcgtgggcgccgtcgccgcgtcggcgctcccggcgctgcgccacgtcaacgtgtccgggaaccagctgggcggcggcctcgacgacggctgggacttcgcgtcgctgcccggcctcgaggtgctggacgcctacgacaacaacttctcggccccgctcccgctcggcgtcgccgcgctcccgaggctccggtacctggacctcggcggcaactacttcaccggcgagatccccgcggcgtacggcgcgatgcccgcggtggagtacctgtccctcaacggcaacaacctgcaggggcgcatcccgccggagctcggcaacctcaccaccctccgggagctctacctcggctactacaacgtgttcgacggcggcatcccgccggcgctcggccggctgcgcagcctcaccgtgctggacgcctccaactgcggcctcacggggcgcgtcccggcggagctcggcgcgctcgcctccctcggcacgctcttcctccacaccaaccagctctctgggcccatcccgccggagctcggcaacctcacgtcgctcgccgcgctggacctctccaacaatgcgctcacgggcgaggtccctcgctcgctggcgtccctcacctcgctcaagctgctcaacctgttcctgaaccggctccgcggcccggtgcccgacttcatcgccgcgctgccgcgtctggagacggtgcagctgttcatgaacaacctcaccggccgcgtccccgcggggctcggcgccagcgccgcgctccggctcgtcgacctgtcctcgaaccgcctcaccggcttcatcccggagacgctctgcgcgtccggccagctccacacggccatcctcatgaacaatttcctcttcgggcccatccccggctcgctcggcacgtgcacgagcctcacgcgggtccggctcggccagaactacctcaacggcagcatccccgccgggctgctgtacctgccgcggctcagcctgctggagctccacaacaacctgctctccggcgccgtgccgtcgaacccgaacccgagcccgagcgcgtccagtttgcagctggcgcagctgaacctgtccaacaacctgctgtccggcccgttgccgagcacgctggccaacctcaccgcgctgcagacgctgcttgcgagcaacaaccggatcggtggcgccgtgccggcggagctcggggagctccggcggctcgtgaagctggacctcagcggcaacgtgctgtcggggcctatccctggggcggtggggcggtgcggcgagctgacgtatctcgatctcagcaggaacaacctgtctggggtgatccccgaggcgatcgcgagcatccgggtgctgaactacctgaacctgtcgcggaacgcgctggaggacgcggtcccggcggcgatcggggccatgagcagccttacggcggcggacttgtcgtacaacgacctgtcggggcagctcccggacacggggcagctggggtacctgaacgcgacggcgttcgcgggcaacccgaggctgtgcggcgcggtggtgggccggccgtgcaactacaccggcgggggcctgggcgtgacggcccggcgcggtggcggggccggggccggggagctgaagctggtgctggcgctggggctcctcgcctgctccgtggggttcgcggcggcggccgtgctccgcgcgcggtcgttccgccgcgtggacgggagcggcggcggcgggggcaggtggcggttcgcggcgttccacaaggtggacttcggcgtggcggaggtgatggagtgcatgaaggacggcaacgtggtagggcgcggcggcgccggggtggtgtacgcggggcgcacccggtcgggcggcgcgatcgcggtgaagcggctgcaggcgcggcggcagggcgacgacgacgacgaccgcgggttccgcgcggaggtgcggacgctgggcagcatccggcaccggaacatcgtgcggctgctggccttgtgcacgaaccgggaggcgaacgtgctggtgtacgagtacatgggcggcggcagcctcggggaggtgctgcacggcaagggcggcgcgttcctggcgtgggagcggcggtacacgatcgcgctggaggcggcgcgcgggctgtgctacctccaccacgactgcacgcccatgatcgtgcaccgggacgtcaagtccaacaacatcctcctcggcgacaacctggaggcccgcgtcgccgacttcgggctcgccaagttcctccgctccggcgccacctccgagtgcatgtccgccgtcgctggatcctacggctacatcgccccttacgcgtacacgctgcgggtggacgagaagagcgacgtgtacagctacggcgtggtcctgctggagctcatcacggggcggcgccccgggggggacttcggggaaggggtggacatcgtgcagtgggccaagcgggccacggccggccgccgggaggccgtgccggggatcgcggaccggcggctcggcgccgcgcccaaagacgaggtggcgcacctcttcttcgtctccatgctctgcgtccaggagaacagcgtcgagcgccccaccatgcgggaggtggtgcagatgctcgccgacgagtccccgcgccgccgcgcgtcgtcgtcgtcgccgcacacgtcgccctccaccacctcctcgtcgccgtcgccgtcgccgtcgccgccgggcgtggaggagagcggcggccccgacggcggcggcaaggagccgccggccaccagctacaagctgttccccgacctgctggcctga

SEQ ID NO: 86 - protein, 980 aa, Arabidopsis sp.
MAMRLLKTHLLFLHLYLFFSPCFAYTDMEVLLNLKSSMIGPKGHGLHDWIHSSSPDAHCSFSGVSCDDDARVISLNVSFTPLFGTISPEIGMLTHLVNLTLAANNFTGELPLEMKSLTSLKVLNISNNGNLTGTFPGEILKAMVDLEVLDTYNNNFNGKLPPEMSELKKLKYLSFGGNFFSGEIPESYGDIQSLEYLGLNGAGLSGKSPAFLSRLKNLREMYIGYYNSYTGGVPPEFGGLTKLEILDMASCTLTGEIPTSLSNLKHLHTLFLHINNLTGHIPPELSGLVSLKSLDLSINQLTGEIPQSFINLGNITLINLFRNNLYGQIPEAIGELPKLEVFEVWENNFTLQLPANLGRNGNLIKLDVSDNHLTGLIPKDLCRGEKLEMLILSNNFFFGPIPEELGKCKSLTKIRIVKNLLNGTVPAGLFNLPLVTIIELTDNFFSGELPVTMSGDVLDQIYLSNNWFSGEIPPAIGNFPNLQTLFLDRNRFRGNIPREIFELKHLSRINTSANNITGGIPDSISRCSTLISVDLSRNRINGEIPKGINNVKNLGTLNISGNQLTGSIPTGIGNMTSLTTLDLSFNDLSGRVPLGGQFLVFNETSFAGNTYLCLPHRVSCPTRPGQTSDHNHTALFSPSRIVITVIAAITGLILISVAIRQMNKKKNQKSLAWKLTAFQKLDFKSEDVLECLKEENIIGKGGAGIVYRGSMPNNVDVAIKRLVGRGTGRSDHGFTAEIQTLGRIRHRHIVRLLGYVANKDTNLLLYEYMPNGSLGELLHGSKGGHLQWETRHRVAVEAAKGLCYLHHDCSPLILHRDVKSNNILLDSDFEAHVADFGLAKFLVDGAASECMSSIAGSYGYIAPEYAYTLKVDEKSDVYSFGVVLLELIAGKKPVGEFGEGVDIVRWVRNTEEEITQPSDAAIVVAIVDPRLTGYPLTSVIHVFKIAMMCVEEEAAARPTMREVVHMLTNPPKSVANLIAF

SEQ ID NO: 87 - protein, 1051 aa, Zea mays
MSLPTRLVLLLPLLLLHGILPAPTSASAAPLRSETDREALLELKAVLGQRSSRLSSWNSSASLCLWPGVTCSHRHGGRVSALHLSSAGLAGTIPASVGNLTFLTSIDLSQNKLEGEIPAAVGRLHRLRYLDMSNNSLQSEIPAGLRNCSSLVSIRLGGNQLTGGVPGWLGGLPKLQGVLLGPNNLTGLIPRSLANLTSSLREINLETNHLARGHHPRGLRKPYLRRHPRGPLLNVSSLITLAVSDNTMHGTLPSDMGAGLPMIRYLLLSRNLFAGGVPPSLGNATMLHVIDLSVNSLTGTIPPGVGRLCPDTLAFDDNMLEASSAQDWEFITSFTNCTRGLRLLSLQYNLLGGELPSSVANLSSQLQLLYLSANEISGKIPLDIGNLAGLQALKLDYNQFSGSLPTSIGRLSTLKLLQFSNNNLSGSLPSSIGNLTQLQILLAYKNAFVGPLPSSLGNLQQLNGVGLSNNKFTGPLPKEIFNLSSLTDDLYLSYNYFVGSLPPEVGSLTNLVHLYISGNNLSGPLPDSLGNCLSMMELRLDGNSFSGAIPTSFSSMRGLVLLNLTDNMLSGKIPQELSRISGLEELYLAHNNLSGPIPHTFGNMTSLNHLDLSFNQLSGQIPVQGVFTNVTGFSFAGNDELCGGVQELHLPACANKPLWHSRRNHHIILKVVIPVAGALLLFMTLAVLVRTLQKKSKAQSEAAPVTVEGALQLMDDVYPRVSYADLVRGTDGFSLSNRIGTGRYGSVYKGSLVINNATTIVAVKVFDLQQSGSLRSFMSECEALRKVRHRNLVSVITCCSGYDSNQNNFKAIVLEYMTNGSLDKWIHPDQGGQSTDPVGLTLMQRLNIAIDTCDAMDYLHNSCQPPIVHCDLKPSNILLNEDFGALVGDFGIAKILRDSTGDPSNMNSRSSTGTGIRGTIGYVAPEYGEGHQVSPCGDVYSFGILLLELFTGKAPTNDMFADGLSLQGYVQAAFPDHLVDIVDPAIVAAEENYAHDVHSGTSNGPRGQNNSVMVSVTGLALLCTKQAPAERISMRNAATELRKIRAHFIRQ

SEQ ID NO: 88 - protein, 361 aa, Zea mays
VIHGCSYVTAMTNDQDLEFELCHVKHFAFHDLQSATDNFNSKNILGQGGFGIVYKGCLRNGTLVVVKRLKDPDVIGEVQFQTEVELIGLAVHRNLLRLYGFCMTSKERLLVYPYMPNGSVADRLRDYRNGKPSLDWSKRMRIALGTARGLLYLHEQCNPKIIHRDVKAANILLDGNFEAIVGDFGLAKLLDRQESHVTTAIRGTIGHIAPEYLSTGQSSEKTDVYGIGILLLELITGPKTLSNGHGQSQKGMILDWVRELKEDKRLDKLVDRDLRDSFDILELECSVDVIIQCTQTNPMLWPKLSEILHALEANVTLAETSVELNREPLPYGVPCSSSMRHEDPHDSSSFIIEPIELSGPR

SEQ ID NO: 89 - protein, 625 aa, Zea mays
MASTPRLARLAAAVAAWMLAAAASAGVEAGDPPLSPKGLNYEVAALMAVKSRLRDERGVMALWDINSVDPCTWSMVACSPDKFVVSLQMANNGLSGTLSPSIGSLSHLQTMSLQNNRISGEIPPEIGKLINLNALDLSSNEFIGDIPSSLGHLTRLNYLRLDRNNLSGPIPTDVARLPGLTFLDLSFNNLSGPVPKIYAHDYSLAGNRFLCNSSVIHGCSDVTAMTNGTMSRQVQKAKNHHQLALAISLSVTCSTILVLLFVYWLSYCRWRLPFASADQDLEFELGHVKHFAFHDLQSATDNFNSKNILGQGGFGIVYKGCLRNGTLVAVKRLKDPDVTGEVQFQTEVELIGLAVHRNLLRLYGFCMTSKERLLVYPYMPNGSVADRLRDYRNGKPSLDWSKRMRIALGAARGLLYLHEQCNPKIIHRDVKAANILLDGNFEAIVGDFGLAKLLDRQESHVTTAVRGTIGHIAPEYLSTGQSSEKTDVYGFGILLLELITGPKTLSNGHGQSQKGMILDWVRELKEDKRPDKLVDRDLRDSFDILELECSVDVIIQCTQTNPMLRPKMSEILHALEANVTLAETSVELNREPLPYGVPRSFSVRHEDPHDSSSFIIEPIELSGPR

SEQ ID NO: 90 - protein, 628 aa, Zea mays
MGEVVAASSLALVLLFFCSCGPASGLLSPKGVNYEGQFQALMMIKNYLKDPHGVLKNWDQDSVDPCSWTMVTCSPENLVTGLEAPSQNLSGILSPSIGNLTNLETVLLQNNNINGLIPAEIGKLRKLKTLDLSSNHFSGEIPSSVGHLESLQYLRLNNNTLSGAFPSSSTNLSHLIFLDLSYNNLSGPIPGSLTRTFNIVGNPLICAATMEQDCYGSLPMPMSYGLNNTQGTVIPAKAKSHKVAIAFGATTACISLLFLAVGSLFWWRCRRNRKTLFNVDDHQHIENGNLGNMKRFQFRELQAATENFSSKNILGKGGFGIVYRGQLPDGSLVAVKRLKDGNAAGGEAQFQTEVEMISLAVHRNLLRLYGFCMTASERLLVYPYMSNGSVALRLKGKPPLDWITRKRIALGAARGLLYLHEQCDPKIIHRDVKAANILLDDCCEAIVGDFGLAKLLDHRESHVTTAVRGTVGHIAPEYLSTGQSSEKTDVFGFGILLLELITGQTALEFGKSSNQKGAMLDWVKKMHQEKQLDILVDKGLGSKYDRIELEEMVQVALLCTQFLPGHRPKMSEVVRMLEGDGLAERWEALQHTESHKFKVPEFSFSRCHSDLTDDSSLLVQAVELSGPR

SEQ ID NO: 91 - protein, 643 aa, Zea mays
GWCWVALAAVLAFILPPSNATLSPAGINYEVALMAIKTELEDPYNVLDNWDINSVPCSWRMVTCSSDGYVSALYVTLPCSCPFSRAPAVARSSHMRSFVCRGLPSQSLSGKLSPGIGNLTRLQSLLQNNVISGPIPSTIGRLGMLKTLDMSDNQLTGSIPGSLGNLKNLNYKLNNNSLSGVLPDSIASIDGFALDLSFNNLSGPLPKISARTFIAGNPMICGNKSGDSCSSVSLDPLSYPPDDLKQPQQGIGRSHHIATICGATVGSVAFVAVVVGMLLWWRHRRNQQIFFDVNQYDPEVCLGHLKRYAFKELRAATNNFNSKNILGEGGYGIVYKGYLRDGSVVAVKRLKDYNAVGGEVQFQTEVEVISLAVHRNLLRLIGFCTTESERLLVYPYMPNGSVASQLRHINGKPALDWPRRKRIALGTARGLLYLHEQCDPKIIHRDVKASNVLLDEYFEAIVGDFGLAKLLDHRESHVTTAVRGTVGHIAPEYLSTGQSSEKTDVFGFGVLLVELITGQKALDFGRVANQKGGVLDWVKKLHQEKQLGTMVDKDLGSSYDRVELEEMVQVSLLCTQYHPSHRPRMSEVIRMLEGDGLAERWEASQNVDTPESVSSELLLQKYMDFAADECSLGLEAMELSGPR

SEQ ID NO: 92 - protein, 627 aa, Zea mays
WWWRLPVAALLAAILPSSDATLSPAGINYEVVALMAIKTELEDPYNVLDNWDINSVDPCSWRMVTCSSDGYVSALGLPSQTLSGKLSPGIGNLTRLQSVLLQNNGISGPIPGTIGRLGMLKTLDMSDNQLTGTIPSSLGKLKNLNYLKLNNNSLSGVLPDSLASIDGFALVDLSFNNLSGPLPKISARTFIIAGNPMICGNNSGDKCSSVSLDPLSYPPDDLKTQPQQGIGKSHHIATICGVTVGSVAFIAFVVGILLWWRHRRNQQIFFDVNDQYDTEVCLGHLKRYAFKELRAATNNFNSKNILGEGGYGIVYKGYLRDGSVVAVKRLKDYNAVGGEVQFQTEVEVISLAVHRNLLRLIGFCTTESERLLVYPYMPNGSVASQLREHINAKPALDWSRRKRVALGTARGLLYLHEQCDPKIIHRDVKASNVLLDEYFEAIVGDFGLAKLLDHRESHVTTAVRGTVGHIAPEYLSTGQSSEKTDVFGFGVLLVELVTGQKALDFGRVANQKGGVLDWVKKLHQEKQLGVMVDKDLGSSYDGVELEEMVQLALLCTQYHPSHRPRMSEVIRMLEGEPGLAERWEASQGNVDTPKSVSSELLPPKYVDFAAADESSLGLEAMELSGPR

SEQ ID NO: 93 - protein, 1064 aa, Zea mays
MAARTLLLVLLLLLLGDATSASVSGQREALMKFKAAVTADPGGLLRGWSPASGDHCRWPGVSCGASGEVVALNVTSSPGRALAGALSPAVAALRELRVLALPSHALSGPLPPAIWTLRRLRVLDLSGNRLQGGIPAVLVCVSLQTLDLAYNQLNGSVPAALGALPVLRRLSLACNRFGGAIPDELGGAGCRNLQFLDVSGNMLVGGIPRSLGNCTELQALLLSSNNLDDIIPPEIGRLKNLRALDVSRNSLSGPVPAELGGCIQLSVLVLSNPYAPTAGSDSSDYGELDDFNYFQGGIPDTIATLPKLRMLWAPRATLEGELPGNWSSCQSLEMINLGENLFSGGIPKGLVECENLKFLNLSMNKFTGSVDSSLPVPCMDVFDVSGNQLSGSLPVFMSKKNCLSSQAPRDDLVSEYSSFFTYQALAGFMSSPSPLDAHLTSYHSFSRNNFTGPVTSLPLATEKLGMQGSYAFLADGNHLGGQLQPSLFDKCNSSRGLVVEISNNLISGAIPTDIGSLCSSLLVLGVAGNQLSGMIPSSIGELSYLISLDLSRNRLGGVIPTSVKNLLHLQRLSLAQNLLNGTIPPDINQLHALKVLDLSSNLLMGMIPDALADLRNLTALLLDNNKLTGKIPSGFANSASLTTFNVSFNNLSGPVPTNGNTVRCDSVIGNPLLQSCHVYTLAVPSAAQQGRGLNSNDSNDTTPSNSQNEGANNSFNAIEIASITSATAIVSILLALIALFIYTRKCAPRMSARSSGRREVTLFQDIGVPITYETVVRATGSFNASNCIGSGGFGATYKAEIAPGVLVAIKRLSVGRFQGAQQFDAEIKTLGRLRHPNLVTLVGYHLGESEMFLIYNYLSGGNLERFIQERSKRPVDWKMLHKIALDVAKALAYLHDTCVPRILHRDVKPSNILLDTNYTAYLSDFGLARLLGNSETHATTGVAGTFGYVAPEYAMTCRVSDKADVYSYGVVLMELISDKKALDPSFSPYGNGFNIVAWACMLLRQGRAREFFIDGLWDVGPHDDLVETLHLAVICTADSLSIRPTMKQVVQRLKQLQPPIREHR

SEQ ID NO: 94 - protein, 1039 aa, Zea mays
MRPSPPLLLLVLLHFALLSTNANGNGDLRGDAMALLALKAALSCRPGALRSWSVANAGSVCAWAGVRCAAGRVVAVDIANMNVSDGTPVSARVTGLGALETISLAGNGIVGAVAASALPALRHVNVSGNQLGGGLDDGWDFASLPGLEVLDAYDNNFSAPLPLGVAALPRLRYLDLGGNYFTGEIPAAYGAMPAVEYLSLNGNNLQGRIPPELGNLTTLRELYLGYYNVFDGGIPPALGRLRSLTVLDASNCGLTGRVPAELGALASLGTLFLHTNQLSGPIPPELGNLTSLAALDLSNNALTGEVPRSLASLTSLKLLNLFLNRLRGPVPDFIAALPRLETVQLFMNNLTGRVPAGLGASAALRLVDLSSNRLTGFIPETLCASGQLHTAILMNNFLFGPIPGSLGTCTSLTRVRLGQNYLNGSIPAGLLYLPRLSLLELHNNLLSGAVPSNPNPSPSASSLQLAQLNLSNNLLSGPLPSTLANLTALQTLLASNNRIGGAVPAELGELRRLVKLDLSGNVLSGPIPGAVGRCGELTYLDLSRNNLSGVIPEAIASIRVLNYLNLSRNALEDAVPAAIGAMSSLTAADLSYNDLSGQLPDTGQLGYLNATAFAGNPRLCGAVVGRPCNYTGGGLGVTARRGGGAGAGELKLVLALGLLACSVGFAAAAVLRARSFRRVDGSGGGGGRWRFAAFHKVDFGVAEVMECMKDGNVVGRGGAGVVYAGRTRSGGAIAVKRLQARRQGDDDDDRGFRAEVRTLGSIRHRNIVRLLALCTNREANVLVYEYMGGGSLGEVLHGKGGAFLAWERRYTIALEAARGLCYLHHDCTPMIVHRDVKSNNILLGDNLEARVADFGLAKFLRSGATSECMSAVAGSYGYIAPYAYTLRVDEKSDVYSYGVVLLELITGRRPGGDFGEGVDIVQWAKRATAGRREAVPGIADRRLGAAPKDEVAHLFFVSMLCVQENSVERPTMREVVQMLADESPRRRASSSSPHTSPSTTSSSPSPSPSPPGVEESGGPDGGGKEPPATSYKLFPDLLA

SEQ ID NO: 95 - protein, 1028 aa, Zea mays
MRPSPPLLLFVLLHFALLSTIAAADGNGNGNGNGDLRGDAMALLALKAALGCRPGALRSWSEGNAGSVCAWTGVRCAAGRVVAVDIANMNVSSGAPVSARVTGLSALETISLAGNGIVGAVAASSLPALRHVNVSGNQLGGGLDGWDFASLPGLEVLDAYDNNFSAPLPLGVAALPRLRYLDLGGNYFTGEIPAAYGAMPAVEYLSLNGNNLQGRIPPELGNLTTLRELYLGYYNVFDGGIPPALGRLRSLTVLDVSNCGLTGRVPAELGALASIETLFLHTNQLSAPIPPELGNLTSLTALDLSNNALTGEVPRSLASLTSLKLLNLFLNRLHGPVPDFIAALPRLETVQLFMNNLTGRVPAGLGANAALRLVDLSSNRLTGVIPEALCASGDLHTVILMNNFLFGPPGSFGSCTSLTRVRLGQNYLNGSIPAGLLYLPRLSLLELHNNLLSGAVPSNPSPSASSSQLAQLNLSNNLLAGPLPSTLANLTALQTLLASNNRIGGAVPPEVGELRRLVKLDLSGNELSGPIPGAVGQCGELTYLDLSRNNLSGAIPEAIAGVRVLNYLNLSRNALEDAIPTAIGAMSSLTAADFSYNDLSGQLPDGQLGYMNATAFAGNPRLCGSVVSRPCNYTGGGGVAGAATTRLGGLKLVLALGLLACSVVFAVAAVLRRSFRVDVGAGRWRLTAFHKVDFGVAEVIECMKDGNVVGRGGAGVVYAGRTRSGGAIAVKRLQAQGGAGAQQGDDRGFRAEVRTLGSIRHRNIVRLLAFCTNREANVLVYEYMGGGSLGVVLHGKGGAFLAWERRYRIALEAARGCYLHHDCTPMIVHRDVKSNNILLGDNLEARVADFGLAKFLRCGATSESMSAVAGSYGYIAPYAYTLRVDEKSDVYSYGVVLLELITGRRPGDFGEGVDIVQWAKRATAGRREAVPGVDRRLVGGAPADEVAHLFFVSMLCVQDNSVERPTMREVVQMLAELPRHESSPSTSSSSSSSSAVEPPPPQAGEESSPDDGKEPPANCYKLFPDLLA

SEQ ID NO: 96 - protein, 989 aa, Zea mays
LDLVVLLLLPIFLLSSSSCLVLAIPTLASQAATLLSLKDSFSPPLPPQLRSWTLANYASLCSSWPGVACSNRTVVSLDISGYNLSGTLPPAIADLAGLRFFSAAANSLSGDIPPAIAALRDLRHLNLSNNQFNGTLDALDFSAMHSLQVLDLYDNDLAGALPTLLPAAAGLRHLDLGGNFFSGTIPPSFGRFPAIQFLSLAGNSLSGDIPPDLANLSTLRHLFLGYFNRFDGGIPAELGRLTSLVHLDLANCGLQGPIPASLGDLTGLDTLYLQTNQLNGTIPPSLGNLTGLRFLDVSNNALGEIPPELAALRELRLLNMFINRFRGGVPDFLGDLRSLQVLKLWQNNFTGAPAALGRAAPLREVDLSTNRLTGEVPRWLCARGQLEILILLDNFLFGPVPEGLGACPTLTRVRLGQNYLTGPLPRGFLYLPALTTVELQGNYLTGRLEEDGSGSSRLSLLNLSSNRFNGSLPASMGNFSWLQTLLLGGNQLGGQIPRQVGRLKRLLKLDLSGNKLTGAVPGEVGECTSLTYLDLSGNRLSGAIPVRLVQIKVLNYLNVSWNMLSGSIPRELGGMKSLTAADFSHNELSGRVPESGQFAYLNGSSFVGNPGLVVVNPKQQVMGGGPGILGGAGTQDERGSSSSSAVMGRLKLLLAAVGLLGFSVAFAAAAVATTRSAAMLRRRRRSSSWRWRMTAFQQVSFGCEDVVRCVKENCVVGRGGAGVVYRGTMPGGECVAVKRIVSAEGGGFQAEVETLGGIRHRHIVRLLAFCSGPEAKLLVYEYMVNGSLGEALHRADDGGGGVVLSWASRLRVATEAAKGLCYLHHDCSPPILHRDVKSNNILLDARMEAHVADFGLAKFLGGSGASECMSAVAGSYGYIAPYAYTLKVDEKSDVYSFGVVLLELITGLKPVGEHLGDDAVDLVQWARARSSAGGGVLALLDPRLGGDVPVAEAAHVLFVSMLCVQEHSVERPTMREVVQMLQQARHQPS

SEQ ID NO: 97 - protein, 1033 aa, Zea mays
MAMAPSTAAASALLPVLLLIATATQCTAADSFSSPDAAALLNLSAAVADPSGYLSTHWTPDTAVCSWPRVSCDATDTRVISLDLSGLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISEEIPPELANLTSLDTLFLQINALSGRLPTEIGAMGSLKSLDLSNNLFVGEIPASFALLKNLTLLNLFRNRLAGEIPEFIGDLPNLEVLQLWENNFTGGIPTNLGVAATRLRIVDVSTNKLTGVLPSELCAGQRLETFIALGNSLFGDVPDGLAGCPSLTRIRLGENFLNGTIPAKLFTLPNLTQVELHNNLLSGELRLDGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGNLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPFRRVCRFNGSSLGIVGCDLMWPRFLCPPSPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTSIDVPLVIEPKEEDGGPEKKKKQQQQQQEGPHDSPPQQDLLSI

SEQ ID NO: 98 - protein, 1036 aa, Zea mays
PMPMRLLLLLTFLATAAAVAGAAGGAAAAGSDADALLAAKAVLSDPAGALASWTNATSTGACAWSGVTCNARAAVIGLDLSGRNLSGPVPTALSRLAHLARLDLAANALCGPIPAPLSRLQSLTHLNLSNNVLNGTFPPPLARLRALRVLDLYNNNLTGPLPLAVVGLPVLRHLHLGGNFFSGEIPPEYGRWRRLQYLAVSGNELSGRIPPELGGLTTLRELYIGYYNSYSSGLPPELGNMTDLVRLDAANCGLSGEIPPELGNLANLDTLFLQVNGLAGAIPPELGRLKSLSSLDLSNNALTGEIPASFASLRNLTLLNLFRNKLRGSIPELVGDLPSLEVLQLWNNFTGGIPRRLGRNGRLQLVDLSSNRLTGTLPPELCAGGKLETLIALGNFLFGSIPEPLGKCEALSRIRLGENYLNGSIPEGLFELPNLTQVELQDNLLSGGFPAVSSTGAPNLGAITLSNNQLTGALPASIGKFSGLQKLLLDQNAFTGAVPPEIGRLQQLSKADLSGNTLDGGVPPEIGKCRLLTYLDLSRNNLSGEIPPAISGMRILNYLNLSRNHLGGEIPATIAAMQSLTAVDFSYNNLSGLVPATGQFSYFNATSFVGNPGLCGPYLGPCHSGGAGTGHDAHTYGGMSNTFKLLIVLGLLVCSIAFAAMAILKARSLKKASEARAWRLTAFQRLEFTCDDVLDSLKEENIIGKGGAGIVYKGTMPDGEHVAVKRLSSMSRGSSHDHGFSAEIQTLGRIRHRYIVRLLGFCSNNETNLLVYEFMPNGSGELLHGKKGGHLHWDTRYKIAVEAAKGLSYLHHDCSPPILHRDVKSNNILLDSDFEAHVADFGLAKFLQDSGASQCMSAIAGSYGYIAPYAYTLKVDEKSDVYSFGVVLLELVTGKKPVGEFGDGVDIVHWVRSTTAGASKEQVVKVMDPRLSSVPVHEVAHVFCVALLCVEEQSVQRPTMREVVQMLGELPKPAAAAAAAAAGQGDEVPGGGGGDDECSAAPSGAPAADGSVEAAHGEATKEPSSQSSPTTDLISI

SEQ ID NO: 99 - protein, 1029 aa, Zea mays
MRLLPLLLLLSLAAVAAGTDADADALLAAKAALSDPTGALASWDAASSDHCAWVGVTCAPRGSGGGVVVGLDVSGLNLSGALPPALSRLRGLQRLSVAANGFYGPIPPSLARLQLLVHLNLSNNAFNGFPPALARLRALRVLDLYNNNLTSATLPLEVTHMPMLRHLHLGGNFFSGEIPPEYGRWPRLQYLAVSGNELSGKIPPELGNLTSLRELYIGYYNSYTGGLPPELGNLTELVRLDAANCGLSGEIPPELGRLQNLDTLFLQVNGLTGSIPSELGYLRSLSSLDLSNNALTGEIPASFSELKNLTLLNLFRNKLRGDIPGFVGDLPSLEVLQLWENNFTGGVPRRLGRNGRLQLLDLSSNKLTGTLPPELCAGGKLQTLIALGNFLFGAIPDSLGQCKSLSRVRLGENYLNGSIPGLFELPKLTQVELQDNLLTGNFPAVIGAAAPNLGESLSNNQLTGALPASLGNFSGVQKLLLDQNAFSGAIPPEIGRLQQLSKADLSSNKFEGGVPPEVGKCRLLTYLDMSQNNLSGKIPPAISGMRILNLNLSRNHLDGEIPPSIATMQSLTAVDFSYNNLSGLVPGTGQFSYFNATSFVGNPGLCGPYLGPCGAGIGGADHSVHGHGWLTNTVKLLIVLGLLICSIAFAVAAILKARSLKKASEARVWKLTAFQRLDFTSDDVLDCLKEEHIIGKGGAGIVYKGMPNGELVAVKRLPAMGRGSSHDHGFSAEIQTLGRIRHRHIVRLLGFCSNNETNLLVYEYMPNGSLGEMLHGKKGGHLHWDTRYSIAIEAAKGLCYLHHDCSPLILHRDVKSNNILLDSNFEAHVADFGLAKFLQDSGASECMSAIAGSYGYIAPEYAYTLKVDEKSDVYSFGVVLLELVTGRKPVGEFGDGVDIVQWAKMTTNSNKEQVMKVLDPRLSTVPLHEVTHVFYVALLCTEEQSVQRPTMREVVQILSELPKPPSTKQGEENSTKQGEEVPNSGDGSAPSPLHSAPVGTNEAPAVEARDHQQQTSSPSSPPPPDLISI

SEQ ID NO: 100 - protein, 1023 aa, Zea mays
MRLLPMLLLLALAAGAAGAAGGSTDADALLAVKAAVSDPTGALASWDAASSDHCAWVGVTCAPRGYGGGVVVGLDVSGLNLSGALPPALSRLRGLQRLSVGANGFYGLPPSLARLQLLVHLNLSNNAFNGSFPPALARLRALRVLDLYNNNLTSATLPLEVTHMPMLRHLHLGGNFFSGEIPPEYGRWPRLQYLAVSGNELSGKIPPELGNLTSLKELYIGYYNSYSGGLPPELGNLTELVRLDAANCGLSGEIPPELGRLQNLDTLFLQVNGLTGSIPSDLGYLRSLSSLDLSNNALTGEIPASFSELKNLTLLNLFRNKLRGDIPDFVGDLPSLEVLQLWENNFTGGVPRRLGRNGRLQVLDLSSNKLTGTLPSELCGGKLETLIALGNFLFGAIPGSLGQCKSLSRVRLGENYLNGSIPKGLFELPKLTQVELQDNLLTGNLPAVIGAAAPNLGEISLSNNQLTGALPASIGNFSGVQKLLLDQNAFSGAIPPEIGRLQQLSKADLSSNKFEGGVPAEIGKCRLLTYLDISNNLSGKIPPAISGMRILNYLNLSRNHLDGEIPPSIATMQSLTAVDFSYNNLSGLVPWTGQFSYFNATSFVGNPGLCGPYLGPCSAGIAGGDHTAHDHGELTNSVKLLIVLGLLICSIAFAAAAILKARSLKKASEARVWKLTAFQRLDFTSDDVLEWLKEENIIGKGGAGIVYKGAMPNGELVAVKRLAAMGRGSSHDHGFSAEIQTLGRIRHRHIVRLLGFCSNSETNLLVYEYMPNGSLGEMLHGNKGGHLHWDTRYSIAIEAAKGLCYLHHDCSPLILHRDVKSNNILLDSNFEAHVADFGLAKFLQDSGASECMSAIAGSYGYIAPYAYTLKVDEKSDVYSFGVVLLELVTGRKPVGEFGDGVDIVQWAKLTTGSKKEQVMRILDPRLSTVPLHEVTHAFYVALLCTEEQSVQRPTMREVVQILSEFPRPSSKQGEEAPDSSDGSPSSPLHPAPVGSNETPTAEAREQQQQTSSRSSPTPDLISI

SEQ ID NO: 101 - DNA, 20 bp, Artificial sequence
  Synthetic oligonucleotide
aatagtgccccgaattgcag

SEQ ID NO: 102 - DNA, 20 bp, Artificial sequence
  Synthetic oligonucleotide
tcgccagtccaaagtccgag

SEQ ID NO: 103 - DNA, 20 bp, Artificial sequence
  Synthetic oligonucleotide
ggaattgcaaagattcttag

SEQ ID NO: 104 - DNA, 20 bp, Artificial sequence
  Synthetic oligonucleotide
gggctcgccaagttcctccg

SEQ ID NO: 105 - DNA, 20 bp, Artificial sequence
  Synthetic oligonucleotide
gggctcgccaagttcttgca

SEQ ID NO: 106 - DNA, 20 bp, Artificial sequence
  Synthetic oligonucleotide
tggcgaagctcctggaccac

SEQ ID NO: 107 - DNA, 20 bp, Artificial sequence
  Synthetic oligonucleotide
tttcgccaatccaaaatccc

SEQ ID NO: 108 - DNA, 20 bp, Artificial sequence
  Synthetic oligonucleotide
aaatgttccagctacaccag

SEQ ID NO: 109 - DNA, 20 bp, Artificial sequence
  Synthetic oligonucleotide
tggcgaaactcctggaccac

SEQ ID NO: 110 - DNA, 20 bp, Artificial sequence
  Synthetic oligonucleotide
ctcgccaagttcctccggtg

SEQ ID NO: 111 - DNA, 20 bp, Artificial sequence
  Synthetic oligonucleotide
ctcgccaagttcctccgctc

SEQ ID NO: 112 - DNA, 20 bp, Artificial sequence
  Synthetic oligonucleotide
gggctagcaaaattcttgca

SEQ ID NO: 113 - DNA, 20 bp, Artificial sequence
  Synthetic oligonucleotide
ggtcttgcgaaattcttgca

SEQ ID NO: 114 - DNA, 20 bp, Artificial sequence
  Synthetic oligonucleotide
gggctggccaagttcctggg

SEQ ID NO: 115 - DNA, 20 bp, Artificial sequence
  Synthetic oligonucleotide
aacagttccgcgcacagctg

SEQ ID NO: 116 - DNA, 20 bp, Artificial sequence
  Synthetic oligonucleotide
aaccccgaacccaaacacgt

SEQ ID NO: 117 - DNA, 20 bp, Artificial sequence
  Synthetic oligonucleotide
aaccccgaacccaaacacgt

SEQ ID NO: 118 - protein, 7 aa, Artificial sequence
  Synthetic peptide
  MISC_FEATURE (2)..(2): Xaa denotes Val, Ile or Leu
  MISC_FEATURE (4)..(4): Xaa denotes Arg or Cys
  MISC_FEATURE (6)..(6): Xaa denotes Leu or Val
IXHXDXK

SEQ ID NO: 119 - protein, 4 aa, Artificial sequence
  Synthetic peptide
  MISC_FEATURE (2)..(2): Xaa denotes Ile or Val
NXLL

SEQ ID NO: 120 - protein, 8 aa, Artificial sequence
  Synthetic peptide
  MISC_FEATURE (6)..(6): Xaa denotes Lys or Arg
  MISC_FEATURE (7)..(7): Xaa denotes Leu or Phe
DFGLAXXL

SEQ ID NO: 121 - protein, 6 aa, Artificial sequence
  Synthetic peptide
  MISC_FEATURE (1)..(1): Xaa denotes Ser or Thr
  MISC_FEATURE (2)..(2): Xaa denotes Ser or Thr
  MISC_FEATURE (3)..(3): Xaa denotes Val or Ile
  MISC_FEATURE (4)..(4): Xaa denotes Ala or Arg
  MISC_FEATURE (6)..(6): Xaa denotes Thr or Ser
XXXXGX

SEQ ID NO: 122 - protein, 12 aa, Artificial sequence
  Synthetic peptide
  MISC_FEATURE (3)..(3): Xaa denotes Phe or Tyr
  MISC_FEATURE (4)..(4): Xaa denotes Gly or Ser
  MISC_FEATURE (5)..(5): Xaa denotes Phe, Tyr or Ile
  MISC_FEATURE (7)..(7): Xaa denotes Ile or Val
  MISC_FEATURE (8)..(8): Xaa denotes Leu or Val
  MISC_FEATURE (10)..(10): Xaa denotes Leu, Val or Met
DVXXXGXXLXEL

SEQ ID NO: 123 - protein, 30 aa, Zea mays
IVHCDLKPSNILLNEDFGALVGDFGIAKIL

SEQ ID NO: 124 - protein, 30 aa, Zea mays
IIHRDVKAANILLDGNFEAIVGDFGLAKLL

SEQ ID NO: 125 - protein, 30 aa, Zea mays
IIHRDVKAANILLDDCCEAIVGDFGLAKLL

SEQ ID NO: 126 - protein, 30 aa, Zea mays
IIHRDVKASNVLLDEYFEAIVGDFGLAKLL

SEQ ID NO: 127 - protein, 30 aa, Zea mays
ILHRDVKPSNILLDTNYTAYLSDFGLARLL

SEQ ID NO: 128 - protein, 30 aa, Zea mays
IVHRDVKSNNILLGDNLEARVADFGLAKFL

SEQ ID NO: 129 - protein, 30 aa, Zea mays
ILHRDVKSNNILLDARMEAHVADFGLAKFL

SEQ ID NO: 130 - protein, 30 aa, Zea mays
ILHRDVKSNNILLDADFEAHVADFGLAKFL

SEQ ID NO: 131 - protein, 30 aa, Zea mays
ILHRDVKSNNILLDSDFEAHVADFGLAKFL

SEQ ID NO: 132 - protein, 30 aa, Zea mays
ILHRDVKSNNILLDSNFEAHVADFGLAKFL

SEQ ID NO: 133 - protein, 21 aa, Zea mays
FGALVGDFGIAKILRDSTGDP

SEQ ID NO: 134 - protein, 21 aa, Zea mays
FEAIVGDFGLAKLLDRQESHV

SEQ ID NO: 135 - protein, 21 aa, Zea mays
CEAIVGDFGLAKLLDHRESHV

SEQ ID NO: 136 - protein, 21 aa, Zea mays
FEAIVGDFGLAKLLDHRESHV

SEQ ID NO: 137 - protein, 21 aa, Zea mays
YTAYLSDFGLARLLGNSETHA

SEQ ID NO: 138 - protein, 21 aa, Zea mays
LEARVADFGLAKFLRSGATSE

SEQ ID NO: 139 - protein, 21 aa, Zea mays
LEARVADFGLAKFLRCGATSE

SEQ ID NO: 140 - protein, 21 aa, Zea mays
MEAHVADFGLAKFLGGSGASE

SEQ ID NO: 141 - protein, 21 aa, Zea mays
FEAHVADFGLAKFLRGNAGGS

SEQ ID NO: 142 - protein, 21 aa, Zea mays
FEAHVADFGLAKFLQDSGASQ

SEQ ID NO: 143 - protein, 21 aa, Zea mays
FEAHVADFGLAKFLQDSGASE

SEQ ID NO: 144 - protein, 41 aa, Zea mays
KPSNILLNEDFGALVGDFGIAKILRDSTGDPSNMNSRSSTG

SEQ ID NO: 145 - protein, 41 aa, Zea mays
KAANILLDGNFEAIVGDFGLAKLLDRQESHVTTAVRGTIGH

SEQ ID NO: 146 - protein, 41 aa, Zea mays
KAANILLDDCCEAIVGDFGLAKLLDHRESHVTTAVRGTVGH

SEQ ID NO: 147 - protein, 41 aa, Zea mays
KASNVLLDEYFEAIVGDFGLAKLLDHRESHVTTAVRGTVGH

SEQ ID NO: 148 - protein, 41 aa, Zea mays
KPSNILLDTNYTAYLSDFGLARLLGNSETHATTGVAGTFGY

SEQ ID NO: 149 - protein, 41 aa, Zea mays
KSNNILLGDNLEARVADFGLAKFLRSGATSECMSAVAGSYG

SEQ ID NO: 150 - protein, 41 aa, Zea mays
KSNNILLGDNLEARVADFGLAKFLRCGATSESMSAVAGSYG

SEQ ID NO: 151 - protein, 41 aa, Zea mays
KSNNILLDARMEAHVADFGLAKFLGGSGASECMSAVAGSYG

SEQ ID NO: 152 - protein, 41 aa, Zea mays
KSNNILLDADFEAHVADFGLAKFLRGNAGGSECMSAIAGSY

SEQ ID NO: 153 - protein, 41 aa, Zea mays
KSNNILLDSDFEAHVADFGLAKFLQDSGASQCMSAIAGSYG

SEQ ID NO: 154 - protein, 41 aa, Zea mays
KSNNILLDSNFEAHVADFGLAKFLQDSGASECMSAIAGSYG

SEQ ID NO: 155 - protein, 21 aa, Arabidopsis
AASECMSSIAGSYGYIAPEYA

SEQ ID NO: 156 - protein, 21 aa, Zea mays
SRSSTGTGIRGTIGYVAPEYG

SEQ ID NO: 157 - protein, 21 aa, Zea mays
QESHVTTAIRGTIGHIAPEYL

SEQ ID NO: 158 - protein, 21 aa, Zea mays
QESHVTTAVRGTIGHIAPEYL

SEQ ID NO: 159 - protein, 21 aa, Zea mays
RESHVTTAVRGTVGHIAPEYL

SEQ ID NO: 160 - protein, 21 aa, Zea mays
SETHATTGVAGTFGYVAPEYA

SEQ ID NO: 161 - protein, 21 aa, Zea mays
ATSECMSAVAGSYGYIAPYAY

SEQ ID NO: 162 - protein, 21 aa, Zea mays
GASECMSAVAGSYGYIAPYAY

SEQ ID NO: 163 - protein, 21 aa, Zea mays
GGSECMSAIAGSYGYIAPFRR

SEQ ID NO: 164 - protein, 21 aa, Zea mays
GASQCMSAIAGSYGYIAPYAY

SEQ ID NO: 165 - protein, 21 aa, Zea mays
GASECMSAIAGSYGYIAPEYA

SEQ ID NO: 166 - protein, 21 aa, Zea mays
GASECMSAIAGSYGYIAPYAY

SEQ ID NO: 167 - protein, 21 aa, Arabidopsis
VDEKSDVYSFGVVLLELIAGK

SEQ ID NO: 168 - protein, 21 aa, Zea mays
VSPCGDVYSFGILLLELFTGK

SEQ ID NO: 169 - protein, 21 aa, Zea mays
SSEKTDVYGIGILLLELITGP

SEQ ID NO: 170 - protein, 21 aa, Zea mays
SSEKTDVYGFGILLLELITGP

SEQ ID NO: 171 - protein, 21 aa, Zea mays
SSEKTDVFGFGILLLELITGQ

SEQ ID NO: 172 - protein, 21 aa, Zea mays
SSEKTDVFGFGVLLVELITGQ

SEQ ID NO: 173 - protein, 21 aa, Zea mays
SSEKTDVFGFGVLLVELVTGQ

SEQ ID NO: 174 - protein, 21 aa, Zea mays
VSDKADVYSYGVVLMELISDK

SEQ ID NO: 175 - protein, 21 aa, Zea mays
VDEKSDVYSYGVVLLELITGR

SEQ ID NO: 176 - protein, 21 aa, Zea mays
VDEKSDVYSFGVVLLELITGL

SEQ ID NO: 177 - protein, 21 aa, Zea mays
VDEKSDVYSFGVVLLELIAGR

SEQ ID NO: 178 - protein, 21 aa, Zea mays
VDEKSDVYSFGVVLLELVTGK

SEQ ID NO: 179 - protein, 21 aa, Zea mays
VDEKSDVYSFGVVLLELVTGR

SEQ ID NO: 180 - protein, 1051 aa, Artificial sequence
  Synthetic polypeptide
MSLPTRLVLLLPLLLLHGILPAPTSASAAPLRSETDREALLELKAVLGQRSSRLSSWNSSASLCLWPGVTCSHRHGGRVSALHLSSAGLAGTIPASVGNLTFLTSIDLSQNKLEGEIPAAVGRLHRLRYLDMSNNSLQSEIPAGLRNCSSLVSIRLGGNQLTGGVPGWLGGLPKLQGVLLGPNNLTGLIPRSLANLTSSLREINLETNHLARGHHPRGLRKPYLRRHPRGPLLNVSSLITLAVSDNTMHGTLPSDMGAGLPMIRYLLLSRNLFAGGVPPSLGNATMLHVIDLSVNSLTGTIPPGVGRLCPDTLAFDDNMLEASSAQDWEFITSFTNCTRGLRLLSLQYNLLGGELPSSVANLSSQLQLLYLSANEISGKIPLDIGNLAGLQALKLDYNQFSGSLPTSIGRLSTLKLLQFSNNNLSGSLPSSIGNLTQLQILLAYKNAFVGPLPSSLGNLQQLNGVGLSNNKFTGPLPKEIFNLSSLTDDLYLSYNYFVGSLPPEVGSLTNLVHLYISGNNLSGPLPDSLGNCLSMMELRLDGNSFSGAIPTSFSSMRGLVLLNLTDNMLSGKIPQELSRISGLEELYLAHNNLSGPIPHTFGNMTSLNHLDLSFNQLSGQIPVQGVFTNVTGFSFAGNDELCGGVQELHLPACANKPLWHSRRNHHIILKVVIPVAGALLLFMTLAVLVRTLQKKSKAQSEAAPVTVEGALQLMDDVYPRVSYADLVRGTDGFSLSNRIGTGRYGSVYKGSLVINNATTIVAVKVFDLQQSGSLRSFMSECEALRKVRHRNLVSVITCCSGYDSNQNNFKAIVLEYMTNGSLDKWIHPDQGGQSTDPVGLTLMQRLNIAIDTCDAMDYLHNSCQPPIVHCDLKPSNILLNEDFGALVGDFGIVKILRDSTGDPSNMNSRSSTGTGIRGTIGYVAPEYGEGHQVSPCGDVYSFGILLLELFTGKAPTNDMFADGLSLQGYVQAAFPDHLVDIVDPAIVAAEENYAHDVHSGTSNGPRGQNNSVMVSVTGLALLCTKQAPAERISMRNAATELRKIRAHFIRQ

SEQ ID NO: 181 - protein, 361 aa, Artificial sequence
  Synthetic polypeptide
VIHGCSYVTAMTNDQDLEFELCHVKHFAFHDLQSATDNFNSKNILGQGGFGIVYKGCLRNGTLVVVKRLKDPDVIGEVQFQTEVELIGLAVHRNLLRLYGFCMTSKERLLVYPYMPNGSVADRLRDYRNGKPSLDWSKRMRIALGTARGLLYLHEQCNPKIIHRDVKAANILLDGNFEAIVGDFGLVKLLDRQESHVTTAIRGTIGHIAPEYLSTGQSSEKTDVYGIGILLLELITGPKTLSNGHGQSQKGMILDWVRELKEDKRLDKLVDRDLRDSFDILELECSVDVIIQCTQTNPMLWPKLSEILHALEANVTLAETSVELNREPLPYGVPCSSSMRHEDPHDSSSFIIEPIELSGPR

SEQ ID NO: 182 - protein, 625 aa, Artificial sequence
  Synthetic polypeptide
MASTPRLARLAAAVAAWMLAAAASAGVEAGDPPLSPKGLNYEVAALMAVKSRLRDERGVMALWDINSVDPCTWSMVACSPDKFVVSLQMANNGLSGTLSPSIGSLSHLQTMSLQNNRISGEIPPEIGKLINLNALDLSSNEFIGDIPSSLGHLTRLNYLRLDRNNLSGPIPTDVARLPGLTFLDLSFNNLSGPVPKIYAHDYSLAGNRFLCNSSVIHGCSDVTAMTNGTMSRQVQKAKNHHQLALAISLSVTCSTILVLLFVYWLSYCRWRLPFASADQDLEFELGHVKHFAFHDLQSATDNFNSKNILGQGGFGIVYKGCLRNGTLVAVKRLKDPDVTGEVQFQTEVELIGLAVHRNLLRLYGFCMTSKERLLVYPYMPNGSVADRLRDYRNGKPSLDWSKRMRIALGAARGLLYLHEQCNPKIIHRDVKAANILLDGNFEAIVGDFGLVKLLDRQESHVTTAVRGTIGHIAPEYLSTGQSSEKTDVYGFGILLLELITGPKTLSNGHGQSQKGMILDWVRELKEDKRPDKLVDRDLRDSFDILELECSVDVIIQCTQTNPMLRPKMSEILHALEANVTLAETSVELNREPLPYGVPRSFSVRHEDPHDSSSFIIEPIELSGPR

SEQ ID NO: 183 - protein, 628 aa, Artificial sequence
  Synthetic polypeptide
MGEVVAASSLALVLLFFCSCGPASGLLSPKGVNYEGQFQALMMIKNYLKDPHGVLKNWDQDSVDPCSWTMVTCSPENLVTGLEAPSQNLSGILSPSIGNLTNLETVLLQNNNINGLIPAEIGKLRKLKTLDLSSNHFSGEIPSSVGHLESLQYLRLNNNTLSGAFPSSSTNLSHLIFLDLSYNNLSGPIPGSLTRTFNIVGNPLICAATMEQDCYGSLPMPMSYGLNNTQGTVIPAKAKSHKVAIAFGATTACISLLFLAVGSLFWWRCRRNRKTLFNVDDHQHIENGNLGNMKRFQFRELQAATENFSSKNILGKGGFGIVYRGQLPDGSLVAVKRLKDGNAAGGEAQFQTEVEMISLAVHRNLLRLYGFCMTASERLLVYPYMSNGSVALRLKGKPPLDWITRKRIALGAARGLLYLHEQCDPKIIHRDVKAANILLDDCCEAIVGDFGLVKLLDHRESHVTTAVRGTVGHIAPEYLSTGQSSEKTDVFGFGILLLELITGQTALEFGKSSNQKGAMLDWVKKMHQEKQLDILVDKGLGSKYDRIELEEMVQVALLCTQFLPGHRPKMSEVVRMLEGDGLAERWEALQHTESHKFKVPEFSFSRCHSDLTDDSSLLVQAVELSGPR

SEQ ID NO: 184 - protein, 643 aa, Artificial sequence
  Synthetic polypeptide
GWCWVALAAVLAFILPPSNATLSPAGINYEVALMAIKTELEDPYNVLDNWDINSVPCSWRMVTCSSDGYVSALYVTLPCSCPFSRAPAVARSSHMRSFVCRGLPSQSLSGKLSPGIGNLTRLQSLLQNNVISGPIPSTIGRLGMLKTLDMSDNQLTGSIPGSLGNLKNLNYKLNNNSLSGVLPDSIASIDGFALDLSFNNLSGPLPKISARTFIAGNPMICGNKSGDSCSSVSLDPLSYPPDDLKQPQQGIGRSHHIATICGATVGSVAFVAVVVGMLLWWRHRRNQQIFFDVNQYDPEVCLGHLKRYAFKELRAATNNFNSKNILGEGGYGIVYKGYLRDGSVVAVKRLKDYNAVGGEVQFQTEVEVISLAVHRNLLRLIGFCTTESERLLVYPYMPNGSVASQLRHINGKPALDWPRRKRIALGTARGLLYLHEQCDPKIIHRDVKASNVLLDEYFEAIVGDFGLVKLLDHRESHVTTAVRGTVGHIAPEYLSTGQSSEKTDVFGFGVLLVELITGQKALDFGRVANQKGGVLDWVKKLHQEKQLGTMVDKDLGSSYDRVELEEMVQVSLLCTQYHPSHRPRMSEVIRMLEGDGLAERWEASQNVDTPESVSSELLLQKYMDFAADECSLGLEAMELSGPR

SEQ ID NO: 185 - protein, 627 aa, Artificial sequence
  Synthetic polypeptide
WWWRLPVAALLAAILPSSDATLSPAGINYEVVALMAIKTELEDPYNVLDNWDINSVDPCSWRMVTCSSDGYVSALGLPSQTLSGKLSPGIGNLTRLQSVLLQNNGISGPIPGTIGRLGMLKTLDMSDNQLTGTIPSSLGKLKNLNYLKLNNNSLSGVLPDSLASIDGFALVDLSFNNLSGPLPKISARTFIIAGNPMICGNNSGDKCSSVSLDPLSYPPDDLKTQPQQGIGKSHHIATICGVTVGSVAFIAFVVGILLWWRHRRNQQIFFDVNDQYDTEVCLGHLKRYAFKELRAATNNFNSKNILGEGGYGIVYKGYLRDGSVVAVKRLKDYNAVGGEVQFQTEVEVISLAVHRNLLRLIGFCTTESERLLVYPYMPNGSVASQLREHINAKPALDWSRRKRVALGTARGLLYLHEQCDPKIIHRDVKASNVLLDEYFEAIVGDFGLVKLLDHRESHVTTAVRGTVGHIAPEYLSTGQSSEKTDVFGFGVLLVELVTGQKALDFGRVANQKGGVLDWVKKLHQEKQLGVMVDKDLGSSYDGVELEEMVQLALLCTQYHPSHRPRMSEVIRMLEGEPGLAERWEASQGNVDTPKSVSSELLPPKYVDFAAADESSLGLEAMELSGPR

SEQ ID NO: 186 - protein, 1064 aa, Artificial sequence
  Synthetic polypeptide
MAARTLLLVLLLLLLGDATSASVSGQREALMKFKAAVTADPGGLLRGWSPASGDHCRWPGVSCGASGEVVALNVTSSPGRALAGALSPAVAALRELRVLALPSHALSGPLPPAIWTLRRLRVLDLSGNRLQGGIPAVLVCVSLQTLDLAYNQLNGSVPAALGALPVLRRLSLACNRFGGAIPDELGGAGCRNLQFLDVSGNMLVGGIPRSLGNCTELQALLLSSNNLDDIIPPEIGRLKNLRALDVSRNSLSGPVPAELGGCIQLSVLVLSNPYAPTAGSDSSDYGELDDFNYFQGGIPDTIATLPKLRMLWAPRATLEGELPGNWSSCQSLEMINLGENLFSGGIPKGLVECENLKFLNLSMNKFTGSVDSSLPVPCMDVFDVSGNQLSGSLPVFMSKKNCLSSQAPRDDLVSEYSSFFTYQALAGFMSSPSPLDAHLTSYHSFSRNNFTGPVTSLPLATEKLGMQGSYAFLADGNHLGGQLQPSLFDKCNSSRGLVVEISNNLISGAIPTDIGSLCSSLLVLGVAGNQLSGMIPSSIGELSYLISLDLSRNRLGGVIPTSVKNLLHLQRLSLAQNLLNGTIPPDINQLHALKVLDLSSNLLMGMIPDALADLRNLTALLLDNNKLTGKIPSGFANSASLTTFNVSFNNLSGPVPTNGNTVRCDSVIGNPLLQSCHVYTLAVPSAAQQGRGLNSNDSNDTTPSNSQNEGANNSFNAIEIASITSATAIVSILLALIALFIYTRKCAPRMSARSSGRREVTLFQDIGVPITYETVVRATGSFNASNCIGSGGFGATYKAEIAPGVLVAIKRLSVGRFQGAQQFDAEIKTLGRLRHPNLVTLVGYHLGESEMFLIYNYLSGGNLERFIQERSKRPVDWKMLHKIALDVAKALAYLHDTCVPRILHRDVKPSNILLDTNYTAYLSDFGLVRLLGNSETHATTGVAGTFGYVAPEYAMTCRVSDKADVYSYGVVLMELISDKKALDPSFSPYGNGFNIVAWACMLLRQGRAREFFIDGLWDVGPHDDLVETLHLAVICTADSLSIRPTMKQVVQRLKQLQPPIREHR

SEQ ID NO: 187 - protein, 1039 aa, Artificial sequence
  Synthetic polypeptide
MRPSPPLLLLVLLHFALLSTNANGNGDLRGDAMALLALKAALSCRPGALRSWSVANAGSVCAWAGVRCAAGRVVAVDIANMNVSDGTPVSARVTGLGALETISLAGNGIVGAVAASALPALRHVNVSGNQLGGGLDDGWDFASLPGLEVLDAYDNNFSAPLPLGVAALPRLRYLDLGGNYFTGEIPAAYGAMPAVEYLSLNGNNLQGRIPPELGNLTTLRELYLGYYNVFDGGIPPALGRLRSLTVLDASNCGLTGRVPAELGALASLGTLFLHTNQLSGPIPPELGNLTSLAALDLSNNALTGEVPRSLASLTSLKLLNLFLNRLRGPVPDFIAALPRLETVQLFMNNLTGRVPAGLGASAALRLVDLSSNRLTGFIPETLCASGQLHTAILMNNFLFGPIPGSLGTCTSLTRVRLGQNYLNGSIPAGLLYLPRLSLLELHNNLLSGAVPSNPNPSPSASSLQLAQLNLSNNLLSGPLPSTLANLTALQTLLASNNRIGGAVPAELGELRRLVKLDLSGNVLSGPIPGAVGRCGELTYLDLSRNNLSGVIPEAIASIRVLNYLNLSRNALEDAVPAAIGAMSSLTAADLSYNDLSGQLPDTGQLGYLNATAFAGNPRLCGAVVGRPCNYTGGGLGVTARRGGGAGAGELKLVLALGLLACSVGFAAAAVLRARSFRRVDGSGGGGGRWRFAAFHKVDFGVAEVMECMKDGNVVGRGGAGVVYAGRTRSGGAIAVKRLQARRQGDDDDDRGFRAEVRTLGSIRHRNIVRLLALCTNREANVLVYEYMGGGSLGEVLHGKGGAFLAWERRYTIALEAARGLCYLHHDCTPMIVHRDVKSNNILLGDNLEARVADFGLVKFLRSGATSECMSAVAGSYGYIAPYAYTLRVDEKSDVYSYGVVLLELITGRRPGGDFGEGVDIVQWAKRATAGRREAVPGIADRRLGAAPKDEVAHLFFVSMLCVQENSVERPTMREVVQMLADESPRRRASSSSPHTSPSTTSSSPSPSPSPPGVEESGGPDGGGKEPPATSYKLFPDLLA

SEQ ID NO: 188 - protein, 1028 aa, Artificial sequence
  Synthetic polypeptide
MRPSPPLLLFVLLHFALLSTIAAADGNGNGNGNGDLRGDAMALLALKAALGCRPGALRSWSEGNAGSVCAWTGVRCAAGRVVAVDIANMNVSSGAPVSARVTGLSALETISLAGNGIVGAVAASSLPALRHVNVSGNQLGGGLDGWDFASLPGLEVLDAYDNNFSAPLPLGVAALPRLRYLDLGGNYFTGEIPAAYGAMPAVEYLSLNGNNLQGRIPPELGNLTTLRELYLGYYNVFDGGIPPALGRLRSLTVLDVSNCGLTGRVPAELGALASIETLFLHTNQLSAPIPPELGNLTSLTALDLSNNALTGEVPRSLASLTSLKLLNLFLNRLHGPVPDFIAALPRLETVQLFMNNLTGRVPAGLGANAALRLVDLSSNRLTGVIPEALCASGDLHTVILMNNFLFGPPGSFGSCTSLTRVRLGQNYLNGSIPAGLLYLPRLSLLELHNNLLSGAVPSNPSPSASSSQLAQLNLSNNLLAGPLPSTLANLTALQTLLASNNRIGGAVPPEVGELRRLVKLDLSGNELSGPIPGAVGQCGELTYLDLSRNNLSGAIPEAIAGVRVLNYLNLSRNALEDAIPTAIGAMSSLTAADFSYNDLSGQLPDGQLGYMNATAFAGNPRLCGSVVSRPCNYTGGGGVAGAATTRLGGLKLVLALGLLACSVVFAVAAVLRRSFRVDVGAGRWRLTAFHKVDFGVAEVIECMKDGNVVGRGGAGVVYAGRTRSGGAIAVKRLQAQGGAGAQQGDDRGFRAEVRTLGSIRHRNIVRLLAFCTNREANVLVYEYMGGGSLGVVLHGKGGAFLAWERRYRIALEAARGCYLHHDCTPMIVHRDVKSNNILLGDNLEARVADFGLVKFLRCGATSESMSAVAGSYGYIAPYAYTLRVDEKSDVYSYGVVLLELITGRRPGDFGEGVDIVQWAKRATAGRREAVPGVDRRLVGGAPADEVAHLFFVSMLCVQDNSVERPTMREVVQMLAELPRHESSPSTSSSSSSSSAVEPPPPQAGEESSPDDGKEPPANCYKLFPDLLA

SEQ ID NO: 189 - protein, 989 aa, Artificial sequence
  Synthetic polypeptide
LDLVVLLLLPIFLLSSSSCLVLAIPTLASQAATLLSLKDSFSPPLPPQLRSWTLANYASLCSSWPGVACSNRTVVSLDISGYNLSGTLPPAIADLAGLRFFSAAANSLSGDIPPAIAALRDLRHLNLSNNQFNGTLDALDFSAMHSLQVLDLYDNDLAGALPTLLPAAAGLRHLDLGGNFFSGTIPPSFGRFPAIQFLSLAGNSLSGDIPPDLANLSTLRHLFLGYFNRFDGGIPAELGRLTSLVHLDLANCGLQGPIPASLGDLTGLDTLYLQTNQLNGTIPPSLGNLTGLRFLDVSNNALGEIPPELAALRELRLLNMFINRFRGGVPDFLGDLRSLQVLKLWQNNFTGAPAALGRAAPLREVDLSTNRLTGEVPRWLCARGQLEILILLDNFLFGPVPEGLGACPTLTRVRLGQNYLTGPLPRGFLYLPALTTVELQGNYLTGRLEEDGSGSSRLSLLNLSSNRFNGSLPASMGNFSWLQTLLLGGNQLGGQIPRQVGRLKRLLKLDLSGNKLTGAVPGEVGECTSLTYLDLSGNRLSGAIPVRLVQIKVLNYLNVSWNMLSGSIPRELGGMKSLTAADFSHNELSGRVPESGQFAYLNGSSFVGNPGLVVVNPKQQVMGGGPGILGGAGTQDERGSSSSSAVMGRLKLLLAAVGLLGFSVAFAAAAVATTRSAAMLRRRRRSSSWRWRMTAFQQVSFGCEDVVRCVKENCVVGRGGAGVVYRGTMPGGECVAVKRIVSAEGGGFQAEVETLGGIRHRHIVRLLAFCSGPEAKLLVYEYMVNGSLGEALHRADDGGGGVVLSWASRLRVATEAAKGLCYLHHDCSPPILHRDVKSNNILLDARMEAHVADFGLVKFLGGSGASECMSAVAGSYGYIAPYAYTLKVDEKSDVYSFGVVLLELITGLKPVGEHLGDDAVDLVQWARARSSAGGGVLALLDPRLGGDVPVAEAAHVLFVSMLCVQEHSVERPTMREVVQMLQQARHQPS

SEQ ID NO: 190 - protein, 1033 aa, Artificial sequence
  Synthetic polypeptide
MAMAPSTAAASALLPVLLLIATATQCTAADSFSSPDAAALLNLSAAVADPSGYLSTHWTPDTAVCSWPRVSCDATDTRVISLDLSGLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISEEIPPELANLTSLDTLFLQINALSGRLPTEIGAMGSLKSLDLSNNLFVGEIPASFALLKNLTLLNLFRNRLAGEIPEFIGDLPNLEVLQLWENNFTGGIPTNLGVAATRLRIVDVSTNKLTGVLPSELCAGQRLETFIALGNSLFGDVPDGLAGCPSLTRIRLGENFLNGTIPAKLFTLPNLTQVELHNNLLSGELRLDGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGNLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLVKFLRGNAGGSECMSAIAGSYGYIAPFRRVCRFNGSSLGIVGCDLMWPRFLCPPSPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTSIDVPLVIEPKEEDGGPEKKKKQQQQQQEGPHDSPPQQDLLSI

SEQ ID NO: 191 - protein, 1036 aa, Artificial sequence
  Synthetic polypeptide
PMPMRLLLLLTFLATAAAVAGAAGGAAAAGSDADALLAAKAVLSDPAGALASWTNATSTGACAWSGVTCNARAAVIGLDLSGRNLSGPVPTALSRLAHLARLDLAANALCGPIPAPLSRLQSLTHLNLSNNVLNGTFPPPLARLRALRVLDLYNNNLTGPLPLAVVGLPVLRHLHLGGNFFSGEIPPEYGRWRRLQYLAVSGNELSGRIPPELGGLTTLRELYIGYYNSYSSGLPPELGNMTDLVRLDAANCGLSGEIPPELGNLANLDTLFLQVNGLAGAIPPELGRLKSLSSLDLSNNALTGEIPASFASLRNLTLLNLFRNKLRGSIPELVGDLPSLEVLQLWNNFTGGIPRRLGRNGRLQLVDLSSNRLTGTLPPELCAGGKLETLIALGNFLFGSIPEPLGKCEALSRIRLGENYLNGSIPEGLFELPNLTQVELQDNLLSGGFPAVSSTGAPNLGAITLSNNQLTGALPASIGKFSGLQKLLLDQNAFTGAVPPEIGRLQQLSKADLSGNTLDGGVPPEIGKCRLLTYLDLSRNNLSGEIPPAISGMRILNYLNLSRNHLGGEIPATIAAMQSLTAVDFSYNNLSGLVPATGQFSYFNATSFVGNPGLCGPYLGPCHSGGAGTGHDAHTYGGMSNTFKLLIVLGLLVCSIAFAAMAILKARSLKKASEARAWRLTAFQRLEFTCDDVLDSLKEENIIGKGGAGIVYKGTMPDGEHVAVKRLSSMSRGSSHDHGFSAEIQTLGRIRHRYIVRLLGFCSNNETNLLVYEFMPNGSGELLHGKKGGHLHWDTRYKIAVEAAKGLSYLHHDCSPPILHRDVKSNNILLDSDFEAHVADFGLVKFLQDSGASQCMSAIAGSYGYIAPYAYTLKVDEKSDVYSFGVVLLELVTGKKPVGEFGDGVDIVHWVRSTTAGASKEQVVKVMDPRLSSVPVHEVAHVFCVALLCVEEQSVQRPTMREVVQMLGELPKPAAAAAAAAAGQGDEVPGGGGGDDECSAAPSGAPAADGSVEAAHGEATKEPSSQSSPTTDLISI

SEQ ID NO: 192 - protein, 1029 aa, Artificial sequence
  Synthetic polypeptide
MRLLPLLLLLSLAAVAAGTDADADALLAAKAALSDPTGALASWDAASSDHCAWVGVTCAPRGSGGGVVVGLDVSGLNLSGALPPALSRLRGLQRLSVAANGFYGPIPPSLARLQLLVHLNLSNNAFNGFPPALARLRALRVLDLYNNNLTSATLPLEVTHMPMLRHLHLGGNFFSGEIPPEYGRWPRLQYLAVSGNELSGKIPPELGNLTSLRELYIGYYNSYTGGLPPELGNLTELVRLDAANCGLSGEIPPELGRLQNLDTLFLQVNGLTGSIPSELGYLRSLSSLDLSNNALTGEIPASFSELKNLTLLNLFRNKLRGDIPGFVGDLPSLEVLQLWENNFTGGVPRRLGRNGRLQLLDLSSNKLTGTLPPELCAGGKLQTLIALGNFLFGAIPDSLGQCKSLSRVRLGENYLNGSIPGLFELPKLTQVELQDNLLTGNFPAVIGAAAPNLGESLSNNQLTGALPASLGNFSGVQKLLLDQNAFSGAIPPEIGRLQQLSKADLSSNKFEGGVPPEVGKCRLLTYLDMSQNNLSGKIPPAISGMRILNLNLSRNHLDGEIPPSIATMQSLTAVDFSYNNLSGLVPGTGQFSYFNATSFVGNPGLCGPYLGPCGAGIGGADHSVHGHGWLTNTVKLLIVLGLLICSIAFAVAAILKARSLKKASEARVWKLTAFQRLDFTSDDVLDCLKEEHIIGKGGAGIVYKGMPNGELVAVKRLPAMGRGSSHDHGFSAEIQTLGRIRHRHIVRLLGFCSNNETNLLVYEYMPNGSLGEMLHGKKGGHLHWDTRYSIAIEAAKGLCYLHHDCSPLILHRDVKSNNILLDSNFEAHVADFGLVKFLQDSGASECMSAIAGSYGYIAPEYAYTLKVDEKSDVYSFGVVLLELVTGRKPVGEFGDGVDIVQWAKMTTNSNKEQVMKVLDPRLSTVPLHEVTHVFYVALLCTEEQSVQRPTMREVVQILSELPKPPSTKQGEENSTKQGEEVPNSGDGSAPSPLHSAPVGTNEAPAVEARDHQQQTSSPSSPPPPDLISI

SEQ ID NO: 193 - protein, 1023 aa, Artificial sequence
  Synthetic polypeptide
MRLLPMLLLLALAAGAAGAAGGSTDADALLAVKAAVSDPTGALASWDAASSDHCAWVGVTCAPRGYGGGVVVGLDVSGLNLSGALPPALSRLRGLQRLSVGANGFYGLPPSLARLQLLVHLNLSNNAFNGSFPPALARLRALRVLDLYNNNLTSATLPLEVTHMPMLRHLHLGGNFFSGEIPPEYGRWPRLQYLAVSGNELSGKIPPELGNLTSLKELYIGYYNSYSGGLPPELGNLTELVRLDAANCGLSGEIPPELGRLQNLDTLFLQVNGLTGSIPSDLGYLRSLSSLDLSNNALTGEIPASFSELKNLTLLNLFRNKLRGDIPDFVGDLPSLEVLQLWENNFTGGVPRRLGRNGRLQVLDLSSNKLTGTLPSELCGGKLETLIALGNFLFGAIPGSLGQCKSLSRVRLGENYLNGSIPKGLFELPKLTQVELQDNLLTGNLPAVIGAAAPNLGEISLSNNQLTGALPASIGNFSGVQKLLLDQNAFSGAIPPEIGRLQQLSKADLSSNKFEGGVPAEIGKCRLLTYLDISNNLSGKIPPAISGMRILNYLNLSRNHLDGEIPPSIATMQSLTAVDFSYNNLSGLVPWTGQFSYFNATSFVGNPGLCGPYLGPCSAGIAGGDHTAHDHGELTNSVKLLIVLGLLICSIAFAAAAILKARSLKKASEARVWKLTAFQRLDFTSDDVLEWLKEENIIGKGGAGIVYKGAMPNGELVAVKRLAAMGRGSSHDHGFSAEIQTLGRIRHRHIVRLLGFCSNSETNLLVYEYMPNGSLGEMLHGNKGGHLHWDTRYSIAIEAAKGLCYLHHDCSPLILHRDVKSNNILLDSNFEAHVADFGLVKFLQDSGASECMSAIAGSYGYIAPYAYTLKVDEKSDVYSFGVVLLELVTGRKPVGEFGDGVDIVQWAKLTTGSKKEQVMRILDPRLSTVPLHEVTHAFYVALLCTEEQSVQRPTMREVVQILSEFPRPSSKQGEEAPDSSDGSPSSPLHPAPVGSNETPTAEAREQQQQTSSRSSPTPDLISI

SEQ ID NO: 194 - protein, 76 aa, Arabadopsis
ILHRDVKSNNILLDSDFEAHVADFGLAKFLVDGAASECMSSIAGSYGYIAPEYAYTLKVDEKSDVYSFGVVLLELI

SEQ ID NO: 195 - protein, 84 aa, Zea mays
IVHCDLKPSNILLNEDFGALVGDFGIAKILRDSTGDPSNMNSRSSTGTGIRGTIGYVAPEYGEGHQVSPCGDVYSFGILLLELF

SEQ ID NO: 196 - protein, 32 aa, Zea mays
TIGHIAPEYLSTGQSSEKTDVYGFGILLLELI

SEQ ID NO: 197 - protein, 75 aa, Zea mays
IIHRDVKAANILLDGNFEAIVGDFGLAKLLDRQESHVTTAIRGTIGHIAPEYLSTGQSSEKTDVYGIGILLLELI

SEQ ID NO: 198 - protein, 75 aa, Zea mays
IIHRDVKAANILLDGNFEAIVGDFGLAKLLDRQESHVTTAVRGTIGHIAPEYLSTGQSSEKTDVYGFGILLLELI

SEQ ID NO: 199 - protein, 75 aa, Zea mays
IIHRDVKAANILLDDCCEAIVGDFGLAKLLDHRESHVTTAVRGTVGHIAPEYLSTGQSSEKTDVFGFGILLLELI

SEQ ID NO: 200 - protein, 75 aa, Zea mays
IIHRDVKASNVLLDEYFEAIVGDFGLAKLLDHRESHVTTAVRGTVGHIAPEYLSTGQSSEKTDVFGFGVLLVELI

SEQ ID NO: 201 - protein, 75 aa, Zea mays
IIHRDVKASNVLLDEYFEAIVGDFGLAKLLDHRESHVTTAVRGTVGHIAPEYLSTGQSSEKTDVFGFGVLLVELV

SEQ ID NO: 202 - protein, 75 aa, Zea mays
ILHRDVKPSNILLDTNYTAYLSDFGLARLLGNSETHATTGVAGTFGYVAPEYAMTCRVSDKADVYSYGVVLMELI

SEQ ID NO: 203 - protein, 75 aa, Zea mays
IVHRDVKSNNILLGDNLEARVADFGLAKFLRSGATSECMSAVAGSYGYIAPYAYTLRVDEKSDVYSYGVVLLELI

SEQ ID NO: 204 - protein, 75 aa, Zea mays
IVHRDVKSNNILLGDNLEARVADFGLAKFLRCGATSESMSAVAGSYGYIAPYAYTLRVDEKSDVYSYGVVLLELI

SEQ ID NO: 205 - protein, 75 aa, Zea mays
ILHRDVKSNNILLDARMEAHVADFGLAKFLGGSGASECMSAVAGSYGYIAPYAYTLKVDEKSDVYSFGVVLLELI

SEQ ID NO: 206 - protein, 107 aa, Zea mays
ILHRDVKSNNILLDADFEAHVADFGLAKFLRGNAGGSECMSAIAGSYGYIAPFRRVCRFNGSSLGIVGCDLMWPRFLCPPSPEYAYTLKVDEKSDVYSFGVVLLELI

SEQ ID NO: 207 - protein, 75 aa, Zea mays
ILHRDVKSNNILLDSDFEAHVADFGLAKFLQDSGASQCMSAIAGSYGYIAPYAYTLKVDEKSDVYSFGVVLLELV

SEQ ID NO: 208 - protein, 76 aa, Zea mays
ILHRDVKSNNILLDSNFEAHVADFGLAKFLQDSGASECMSAIAGSYGYIAPEYAYTLKVDEKSDVYSFGVVLLELV

SEQ ID NO: 209 - protein, 75 aa, Zea mays
ILHRDVKSNNILLDSNFEAHVADFGLAKFLQDSGASECMSAIAGSYGYIAPYAYTLKVDEKSDVYSFGVVLLELV

SEQ ID NO: 210 - protein, 64 aa, Arabidopsis
GYIAPEYAYTLKVDEKSDVYSFGVVLLELIAGKKPVGEFGEGVDIVRWVRNTEEEITQPSDAAI

SEQ ID NO: 211 - protein, 63 aa, Zea mays
GYVAPEYGEGHQVSPCGDVYSFGILLLELFTGKAPTNDMFADGLSLQGYVQAAFPDHLVDIVD

SEQ ID NO: 212 - protein, 66 aa, Zea mays
GHIAPEYLSTGQSSEKTDVYGFGILLLELITGPKTLSNGHGQSQKGMILDWVRELKEDKRLDKLVD

SEQ ID NO: 213 - protein, 66 aa, Zea mays
GHIAPEYLSTGQSSEKTDVYGIGILLLELITGPKTLSNGHGQSQKGMILDWVRELKEDKRLDKLVD

SEQ ID NO: 214 - protein, 66 aa, Zea mays
GHIAPEYLSTGQSSEKTDVYGFGILLLELITGPKTLSNGHGQSQKGMILDWVRELKEDKRPDKLVD

SEQ ID NO: 215 - protein, 66 aa, Zea mays
GHIAPEYLSTGQSSEKTDVFGFGILLLELITGQTALEFGKSSNQKGAMLDWVKKMHQEKQLDILVD

SEQ ID NO: 216 - protein, 66 aa, Zea mays
GHIAPEYLSTGQSSEKTDVFGFGVLLVELITGQKALDFGRVANQKGGVLDWVKKLHQEKQLGTMVD

SEQ ID NO: 217 - protein, 66 aa, Zea mays
GHIAPEYLSTGQSSEKTDVFGFGVLLVELVTGQKALDFGRVANQKGGVLDWVKKLHQEKQLGVMVD

SEQ ID NO: 218 - protein, 67 aa, Zea mays
GYVAPEYAMTCRVSDKADVYSYGVVLMELISDKKALDPSFSPYGNGFNIVAWACMLLRQGRAREFFI

SEQ ID NO: 219 - protein, 63 aa, Zea mays
GYIAPYAYTLRVDEKSDVYSYGVVLLELITGRRPGGDFGEGVDIVQWAKRATAGRREAVPGIA

SEQ ID NO: 220 - protein, 62 aa, Zea mays
GYIAPYAYTLRVDEKSDVYSYGVVLLELITGRRPGDFGEGVDIVQWAKRATAGRREAVPGVD

SEQ ID NO: 221 - protein, 64 aa, Zea mays
GYIAPYAYTLKVDEKSDVYSFGVVLLELITGLKPVGEHLGDDAVDLVQWARARSSAGGGVLALL

SEQ ID NO: 222 - protein, 64 aa, Zea mays
GYIAPYAYTLKVDEKSDVYSFGVVLLELVTGKKPVGEFGDGVDIVHWVRSTTAGASKEQVVKVM

SEQ ID NO: 223 - protein, 64 aa, Zea mays
GYIAPEYAYTLKVDEKSDVYSFGVVLLELVTGRKPVGEFGDGVDIVQWAKMTTNSNKEQVMKVL

SEQ ID NO: 224 - protein, 63 aa, Zea mays
GYIAPYAYTLKVDEKSDVYSFGVVLLELVTGRKPVGEFGDGVDIVQWAKLTTGSKKEQVMRIL

SEQ ID NO: 225 - protein, 8 aa, Zea mays
AMVDLEVL

SEQ ID NO: 226 - protein, 8 aa, Zea mays
GYYNSYTG

SEQ ID NO: 227 - protein, 7 aa, Zea mays
GYVANKD

SEQ ID NO: 228 - DNA, 2380 bp, Zea mays
ccgaggctaggctcgggcgaggcgtgatcgagtccctcgaacggaccgatccctgacttaatcgcacccatcaggcctttgcagcttcgtgctgatgggggttaccagctgagaattaggagctttgagggtacccctaattatggtccccgacactttgactgcacgatgatttgtcatgtagataataattttgctccacctaaaaatgaagcaagaaactgaatttgacacagccactgccgtggtagtgtggcacataactgaattttgctacataactgaatttgttaggagcacacatttcagaactggatttttgagttgcacacacatttcttttgtttcagaactgaatttttgaggtgcacagacatttattttattttagaattgaattttttgttttagaactgaatttttagtgaagagcacacatatttaatagttttggagcatgacattttaaaactaatacaaaactaaatttattacagttatacatggttgttcatatgtgacagcaatgactaatggtaattgctttcccagatggcatatcttttacatatctattctttagaaaccggaacttaactatacattaatggcagggacaaatgtcgagacaggtccaaaaggccaagaaccaccatcaattagctctggcaatattagttttgttgttcgtgtattggctaagttattgcagatggcgcttgccttttgcttcagctggtaattatccaagccttcgcagtattagctctttacaagttaaatttacacaatctgacttttttatctgtagatcaagatctagaattcgaattgtgccatgtgaagcatttcgcatttcacgatctgcaaagtgcaacggacaattttaattccaagaatatattaggtcaaggaggttttggaattgtgtataaaggctgtttgagaaatggaactttagtggtagtgaagagattaaaagatcctgatgttattggtgaagtccaatttcaaacagaagttgagttgattggccttgctgtgcacaggaatctcttgcgtttgtatggattttgcatgacctctaaagaacgattgcttgtatatccatatatgccaaatggcagtgttgctgaccgcttgagaggtaactcaatcgtctacaacatttcaatgttaatgaagtctacaattggcattctgtgcaagtcttttgcatttcttgtaaatattttgtttaacattatgtgttttggttggttctttgccacgaccatatactctgcttatatatccttatacctttgtaatatacggggttgcaattttcagattatcgcaatggaaaaccatctcttgattggagtaaacgcatgcggattgctcttggcactgccagggggttactctaccttcatgaacaatgcaatcctaagatcatccacagggacgtcaaagctgcaaacatattgctcgatggaaatttcgaagcaatcgtcggggattttggattagcaaaacttcttgaccgtcaggaatcacatgttaccactgcaattcggggcactattgggcatattgctcctgagtatctctcaactggacagtcctcggaaaagactgatgtttatgggattggcattctcctattggaactgattactggtcctaagaccttgagcaatggacatggccagtctcagaaaggcatgattctagactgggtaagcttctgtgcacttatttacgttctgtttactgtatttcagccccacgctggagaggtttaacacctgctttcgtgcctattcaggttagagagctaaaggaggacaagagactggataagctggtcgacagggatctcagagattcatttgatattcttgagctggagtgttcagttgacgtgatcatccaatgcacacagacgaaccctatgctgtggcctaagttgtctgaaattctacacgctcttgaagccaatgtcacgctggcggaaaccagcgtcgaattgaacagggaacctcttccttatggcgtgccttgcagttcctctatgaggcatgaggaccctcacgattcatcgtccttcataatagagccaatcgagctatctggtcccagatgacagctgttgtcggtgtggttgaggcgaaaagaaaagaaaagaaaacagggaaatgatacaattgtacaaaacatgtatatcctagatgtagttcaacttggcaatagtttgctgggcgtgttgccgtaccttacataatattttgaacgtgaggctggggcgaaccttgttggctatttttgttgcttacgttttcatctgccatccatgaggcactaaggcggtcatgcattttcgccgaaaaatttc

SEQ ID NO: 229 - DNA, 3477 bp, Zea mays
acccactccactcaccacaccatccatggcgatggcgccctccacggcggccgcatccgcccttctccccgtcctcctcctcatcgccaccgccacccagtgcaccgcagccgattcattctcttccccggacgctgccgccctcctcaacctctctgcggcggtagcagacccctcgggctacctctccacgcactggactccggacaccgcggtctgctcgtggccacgcgtgtcctgcgacgccaccgacacacgagtcatctccctcgacctctccggcctcaacctatctggccccatccccgccgccgcgctctcctctttcccgtacctccaatcgctcaacctctccaacaacatactcaactccaccgccttccccgacgagatcatcgcgtcgctcaagagccttcgcgttctcgacctctacaataacaacctcaccggttcgctgccggcagcgctccccaacctcaccgacctcgtccacgtccacctcggcggcaatttcttctccggcagcatcccgaggtcctacggccagtggagccgcatccggtacctggccctctccgggaacgagctcaccggcgagataccggaggagctcggcaacctgacgacgttgagggagctgtacctcggctactacaacaacttcaccggcggtataccacccgagctcgggaggctgcgggcgctcgtccggctcgacatggctaactgcggcatctccgaggagatcccgccggaactggcgaacttgacgtcgctcgacactctgtttcttcagatcaacgctctgtctgggaggctcccgacggagataggcgcaatggggtcgctcaaatcgctcgacctgtcgaacaacttgttcgtcggggagatccccgcgagcttcgcgttgctcaagaacctgaccctgctgaacctcttccggaatcgcctcgccggtgagattcccgagttcatcggcgacttgccgaacctcgaggttctgcagctgtgggagaacaacttcacaggcgggatacccacgaacctcggcgtggcggcgaccaggctgaggatcgttgacgtgagcacgaacaagctcaccggcgttctgccatccgagctgtgcgccggccagcggctggagacgttcatcgctctgggaaattcgctgttcggcgacgttccggacgggctcgcggggtgcccgtcgctgacgaggattcggctgggagagaattttctcaacgggacgatacctgcaaagctgttcacgttgccgaacctgacgcaggtagagctgcacaacaatttgctctccggcgagctccggctggacggagggaaggtgtcttcttcgatcggagagctgagtctgttcaacaaccgactgaccggccaggtgcctaccgggatcggtggactcctgggattacagaagctgctgctcgccgggaacatgttgtccggcgagctcccgccggaggtcgggaagcttcagcagctctcgaaggcggacctttctgggaacctgctctccggagcggtacccccggcgatcggcagatgccgtctgctcaccttcctcgatatctcgagcaacaagctctccggcagcatcccgccggagctcggcaacctccgcatcctcaactacctcaacgtttcccacaacgcgctccaaggggagattccgcctgccatcgccggaatgcagagcctgacagccgtggacttctcctacaacaacctctcgggcgaggtcccgtccaccggtcagtttggctacttcaacgccacttccttcgcaggcaacgctggcctctgcggggcgttcctgtccccgtgccgctccgtcggcgtggcgacttcggccctggggtccctctcttcgacgtccaaactcctgctcgtgctcggcctcctcgcgctgtccgtcgtcttcgcggcgcggccgtgctgaaggcgcggtcgctgaagcggtccgccgaggcgcgcgcgtggcggctgacggcgttccagcggctggacttcgccgtggacgacgtgctggactgcctcaaggaggagaacgtgatcggcaagggcgggtccgggatcgtgtacaagggcgcgatgccgggcggcgccgtggtggccgtgaagcggctgccggccatcgggcgcgcgggcgcggcgcacgacgactacgggttctcggcggagatacagacgctggggcgcatcaggcaccgccacatcgtgcggctgctcggcttcgcggccaaccgggagaccaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcgggctcgccaagttcctccggggcaacgccggcggttcggagtgcatgtccgctatcgccggctcgtacggctacattgctcctggtacattttcttcacaaatcactcactgcccttgtataattagttatcatctgctccactgcttgtatagtctggtcgttgtcctgtatattcactgctgaaatctgccgctccaactgaaaaggtttttgtttacaatgctgtcctggttttgatagaattcatttgcgttcctaagtacccccagcattaatgcttactagtacgaacatgtagactggctctgttcgtcatgtggaaatttgaacaacagagtggcttccccgcatgcatatgcattgattggtttttactgtgtcccgcacaccagatgcatcgtacatcccctgcaacatctgatggcagcgtttcgtcgcgtttgtcgttttaatggatcatcattgggaattgttggctgcgatctcatgtggcctcgcttcctctgtcccccctccccagagtacgcctacacgctgaaggtggacgagaagagcgatgtgtacagcttcggcgtggtgctgctggagctcatcgccgggcgcaagcccgtcggggagttcggcgacggcgtggacatcgtgcactgggtgcggacggtgaccgggtcgagcaaggagggcgtgatgaagatcgccgacccacggctctcgacggtgcctctgtacgagctaacccacgtcttctacgtcgccatgctgtgcgtggcggagcagagcgtggagcgccccacgatgcgcgaggtcgtgcagatactggccgacatgcccggctcgacatccacgtccatagacgtgccccttgtcatcgagccgaaggaggaggacgggggcccggagaaaaagaagaagcagcagcagcagcagcaggaagggccacacgactcgccgccgcagcaggatcttcttagtatctag

SEQ ID NO: 230 - DNA, 5240 bp, Zea mays
atgaggccttcgccacctctgctcctgctcgtgctcctgcatttcgcgctcctgtccaccaacgccaatgggaacggcgacctgcgcggcgacgcgatggcgctgctggccctcaaggccgcgctcagctgccgcccgggcgcgctgcggtcgtggtcggtggccaatgccgggtccgtgtgcgcgtgggcgggcgtccgctgcgcggccgggcgcgtggtcgccgtcgacatcgccaacatgaacgtgtcggacggcacgcccgtgtcggcccgggtgacggggctcggcgcgctcgagaccatctcgctggccgggaacggcatcgtgggcgccgtcgccgcgtcggcgctcccggcgctgcgccacgtcaacgtgtccgggaaccagctgggcggcggcctcgacgacggctgggacttcgcgtcgctgcccggcctcgaggtgctggacgcctacgacaacaacttctcggccccgctcccgctcggcgtcgccgcgctcccgaggctccggtacctggacctcggcggcaactacttcaccggcgagatccccgcggcgtacggcgcgatgcccgcggtggagtacctgtccctcaacggcaacaacctgcaggggcgcatcccgccggagctcggcaacctcaccaccctccgggagctctacctcggctactacaacgtgttcgacggcggcatcccgccggcgctcggccggctgcgcagcctcaccgtgctggacgcctccaactgcggcctcacggggcgcgtcccggcggagctcggcgcgctcgcctccctcggcacgctcttcctccacaccaaccagctctctgggcccatcccgccggagctcggcaacctcacgtcgctcgccgcgctggacctctccaacaatgcgctcacgggcgaggtccctcgctcgctggcgtccctcacctcgctcaagctgctcaacctgttcctgaaccggctccgcggcccggtgcccgacttcatcgccgcgctgccgcgtctggagacggtgcagctgttcatgaacaacctcaccggccgcgtccccgcggggctcggcgccagcgccgcgctccggctcgtcgacctgtcctcgaaccgcctcaccggcttcatcccggagacgctctgcgcgtccggccagctccacacggccatcctcatgaacaatttcctcttcgggcccatccccggctcgctcggcacgtgcacgagcctcacgcgggtccggctcggccagaactacctcaacggcagcatccccgccgggctgctgtacctgccgcggctcagcctgctggagctccacaacaacctgctctccggcgccgtgccgtcgaacccgaacccgagcccgagcgcgtccagtttgcagctggcgcagctgaacctgtccaacaacctgctgtccggcccgttgccgagcacgctggccaacctcaccgcgctgcagacgctgcttgcgagcaacaaccggatcggtggcgccgtgccggcggagctcggggagctccggcggctcgtgaagctggacctcagcggcaacgtgctgtcggggcctatccctggggcggtggggcggtgcggcgagctgacgtatctcgatctcagcaggaacaacctgtctggggtgatccccgaggcgatcgcgagcatccgggtgctgaactacctgaacctgtcgcggaacgcgctggaggacgcggtcccggcggcgatcggggccatgagcagccttacggcggcggacttgtcgtacaacgacctgtcggggcagctcccggacacggggcagctggggtacctgaacgcgacggcgttcgcgggcaacccgaggctgtgcggcgcggtggtgggccggccgtgcaactacaccggcgggggcctgggcgtgacggcccggcgcggtggcggggccggggccggggagctgaagctggtgctggcgctggggctcctcgcctgctccgtggggttcgcggcggcggccgtgctccgcgcgcggtcgttccgccgcgtggacgggagcggcggcggcgggggcaggtggcggttcgcggcgttccacaaggtggacttcggcgtggcggaggtgatggagtgcatgaaggacggcaacgtggtagggcgcggcggcgccggggtggtgtacgcggggcgcacccggtcgggcggcgcgatcgcggtgaagcggctgcaggcgcggcggcagggcgacgacgacgacgaccgcgggttccgcgcggaggtgcggacgctgggcagcatccggcaccggaacatcgtgcggctgctggccttgtgcacgaaccgggaggcgaacgtgctggtgtacgagtacatgggcggcggcagcctcggggaggtgctgcacggcaagggcggcgcgttcctggcgtgggagcggcggtacacgatcgcgctggaggcggcgcgcgggctgtgctacctccaccacgactgcacgcccatgatcgtgcaccgggacgtcaagtccaacaacatcctcctcggcgacaacctggaggcccgcgtcgccgacttcgggctcgccaagttcctccgctccggcgccacctccgagtgcatgtccgccgtcgctggatcctacggctacatcgcccctggtacgtactatcgttacatctccgtccgtctctgctcatattcaaattcaaattcatattcatacagacgcttaggatttgattgatcggcttagcagccggtcgattgttacgattaatggtagcttgtcgcgttgcacggtgtcacggtacaagtagcagtaggcgtgttggtttagcatccgtactacattggcatgacgtgttgtcgtcgctgggggggaatgggcggcgtaggacccagcgctcagggagaaggtcaaaggtggtgtcagcaagtgaacatgtcaatggccacgggacgcgacgcgacagtcgcgcctcaagcgctgtcctgctcctgcctccgcgccggccggcacgcctccactgtacaccgcaggacacccacacgagtacagtttagtgaccagtgcgtacactgccacagtaccagcgtagacctaatttcttttccttgatggcctccaaaatatggaggcaaataattaacaacgtgaagaatgattgggccatcacaaaccatcaagatctgggcgtgtagtccacatccacaccgacccaccgcgtacgacgcagcctcactcatacgtagacgtactgtacgtacgacgtgccgtacgcgtacgctatggcagtatgagaaggcagcaggccgtgtggcgccgtaccacgtgagcactaaggcatgggcccggcccggcagcgaaagcggccaaaaagaggtccgccgggcaggcagactcgggttcgggcccgccgccagcccgcactcgatcgcccaataattcctggcgcgggccccacccaggcgacgatcgtgattcgtgactgcacgatgtccggctggaggtggccggccaaggtttggtcgggtcagctcaggctcagcacagcaggccagtctagagatgcgaggggcggcagcgcgcagaggcagaggagcagcattgggcagggcttgccaaactcacaaaggccatccaatggctacatcctgaagcctgtaacatatacgccagcgattcgacattggaggtcaggtacacgtataagttgtcactgtcagtacagcagctgacacgacgagtccgactttttttattttgggtcgaagaataccgctcgcgttttttttcctccgtatctttgaccagcacccacgcaagaacacatcccaaagcggcgtgctcctgccttgcctgccccatgcaatgcaatgcaacgtcgccaaagagagacgcgggccatgcgtgctttttcaactggcacacattcgccactgttgcgtgcagtcgcgaacttttttctctttctctttctctttctttctttttggtaacagcgacattcgcttcaatacggtagtttaattttttttcccggtccacgcgcgctcaaagacgcgatttggctgggatcgccttggcagggcatgggcatgcgcaatagacaaagattaactagcgcagcctcttgatccggacgacgacgaattttccttggatttggcaaaggtttgcgggggaaaatattccgatggatttgacactgccctgctcgccattcctcttgggattcgttgcggcgctgtaggtgggtacactactattaggtctttgttctccggaccagctgttgtggtagccactttgtttatccactattcaaaatccatcatgccagcctactagcatgaatgactcgtgtgtgtgtgtgtgttttaaaaaaaaaacagctcgtagctagattcgcatggatttggattcctgcttttaacaacgaaatacgattatgttactgcagctttcaatctgcttaccatactattgcaatctctctctcttttgttcgataattacaaacaaaaaaacaacaacaacaaactttgcagagtacgcgtacacgctgcgggtggacgagaagagcgacgtgtacagctacggcgtggtcctgctggagctcatcacggggcggcgccccgtgggggggacttcggggaaggggtggacatcgtgcagtgggccaagcgggccacggccggccgccgggaggccgtgccggggatcgcggaccggcggctcggcgccgcgcccaaagacgaggtggcgcacctcttcttcgtctccatgctctgcgtccaggagaacagcgtcgagcgccccaccatgcgggaggtggtgcagatgctcgccgacgagtccccgcgccgccgcgcgtcgtcgtcgtcgccgcacacgtcgccctccaccacctcctcgtcgccgtcgccgtcgccgtcgccgccgggcgtggaggagagcggcggccccgacggcggcggcaaggagccgccggccaccagctacaagctgttccccgacctgctggcctgatgaagcgcagacggacgaacggcacctgttttgccatgccactgttaattacaccccaaaaaaacacacacacgacgactcatcatcgtgcaggactgaagttacagcatgtagcgcagcagactggagctagaggttcttcaggttggtcggccgacattggagatggtaacaagatagaactggggatcaataataattaagtaacatgtaactttatt

SEQ ID NO: 231 - DNA, 1403 bp, Zea mays
ggacaaatgtcgagacaggtccaaaaggccaagaaccaccatcaattagctctagcaatattagttttgttgttcgtgtattggctaagttattggagatggcgcttgccttatgcttcagctggtaattatccaagccttcgcagtattagctctttacaagttaaatttacacaatctgacttttttatctgtagatcaagatctagaattcgaattgggccatgtgaagcatttcacatttcacgatctgcaaagtgcaacagacaattttaattccaggaatatattaggtcaaggaggttttggaattgtgtataaaggctgtttgagaaatggaactttagtggcagtgaagagattaaaagatcctgatgttaccggtgaagtccagtttcagacagaagttgagttgattggccttgctgtgcacaggaatctcttgtgtttgtatggattttgcatgacctctaaagaacggttgcttgtatatccatatatgccaaatggcagtgttgctgaccgcttgagaggtaactcactcgtctacaacatttcaatgttaatgaagtctacaattggcattctgtgcaagtcttttgcatttcttgtaaatattttgtttaacattatgtgttttggttggttctttgccacggccatatactctgcttatatatccttatacctttgtaatatacggggttgcaattttcatattatcgcaatggaaaaccatctcttgattggagtaaacgcatgcggattgctcttggcgctgccagggggttactctaccttcatgaacaatgcaatcctaagatcatccacagggacgtcaaagctgcaaacatattgctcgatggaaatttcgaagcaatcgtcggagattttggattggtaaaacttcttgaccgtcaggaatcgcatgttaccactgcagtttgggacactattgggcatattgctcctgagtatctctcaactggacagtcctcggaaaagactgatgtttatgggtttggcattctcctgttggaactgattactggtcctaagaccttgagcaatggacatggccagtctcagaaaggcatgattctagactgggtaagcttctgtgcacttatttgcgttctgtttactgtatttcagccccacgctagagaggtttaacacctgctttcgtgcctattcaggttagagagctaaaggaggacaagagactggataagctggtcgacagggatctcatagattcatttgatattcttgagctggagtgttcagttgacgtgatcatccaatgcacgcagacgaaccctatgttgcggcctaagatgtccgaaattctgcatgctcttgaagccaatgtcacactggcggaaaccagctcgagttga

SEQ ID NO: 232 - DNA, 5400 bp, Zea mays
atgaggccttcgccacctttgctcctgttcgtgctcctgcacttcgcgctcctgtccaccattgccgccgccgatgggaatgggaatgggaatgggaacggcgacctgcgcggcgacgcgatggcgctgctcgccctcaaggccgcgctcggctgccggccgggcgcgctgcggtcgtggtcggagggcaatgccgggtccgtgtgcgcgtggacgggcgtccggtgcgcggccggacgcgttgtcgccgtcgacatcgccaacatgaacgtgtccagcggcgcgcccgtctcggcacgggtgacggggctcagcgcgctcgagaccatctcgctcgccgggaacggcatcgtgggcgccgtcgccgcgtcgtcgctcccggcgctgcgccacgtcaacgtgtcggggaaccagctcggcggcggcctcgacggctgggacttcgcgtcgctgcccggcctcgaggtgctggacgcctacgacaacaacttctcggctccgctcccgctcggcgtcgccgcgctcccgaggctccgctacctggacctcggcggcaactacttcacgggcgagatcccggcggcgtacggcgcgatgcccgcggtggagtacctgtcccttaacggcaacaacctgcaaggccgcatcccaccggagctcggcaacctcaccaccctccgggagctctacctcggttactacaacgtgttcgacggcggcatccccccggcgcttggccggttgcgcagcctcaccgtgctggacgtctccaactgcggcctcacggggcgcgtccccgcggagcttggcgcgctcgcctccatcgagacgctcttcctccacaccaaccaactctccgcgcccatcccgccggagctcggcaacctcacgtcgctcaccgcgctggacctctccaacaatgcgctcaccggcgaggtccctcgctcgctggcgtccctcacctcgctcaagttgctcaacctgttcctgaaccggctccacggaccggtgcccgacttcatcgccgcgctgccgcgtctggagacggtgcagctgttcatgaacaacctcaccggccgcgtccccgcagggctcggcgccaacgccgcgctccggctcgtcgacctgtcctcgaaccgcctcaccggcgtcatcccggaggcgctgtgcgcgtccggcgatctccacacggtcatcctcatgaacaatttcctcttcggcccatccccggctcgttcggctcgtgcacgagcctcacccgcgtccggctcggccagaactacctcaacggcagcatccccgccggcctgctgtacctgccgcggctgagcctgctggagctccacaacaacctgctctcaggcgccgtgccgtcgaacccgagcccgagcgcgtccagttcgcagctggcgcagctcaacctgtccaacaacctgctggcggggccgctgccgagcacgctggccaacctcaccgcgctgcagacgctgcttgcgagcaacaaccggatcggcggcgccgtgccgccggaggtcggggagctccggcggctcgtgaagctcgacctcagcggcaacgagctgtcggggccgattcccggggcggtcgggcagtgcggcgagctgacgtatctcgatctcagcaggaacaacctgtccggggcgatcccagaggcgatcgcgggcgtccgggtgctgaattacctcaacctgtcgcggaacgcgctggaggacgcgatcccgacggcgatcggggccatgagcagcctgacggcggcggacttctcgtacaacgacctgtcagggcagctcccggacacgggcagctggggtacatgaacgcgacggcgttcgcgggcaacccgaggctgtgcggctctgtggtgagccggccgtgcaactacacgggaggaggcggagtcgcgggcgcggcgacgacgcggctcggcgggctgaagctggtgcttgcgctgggactgctcgcctgctcggttgtgttcgccgtggcggccgtgctccggcgcggtcgttccgcgtggacgtcggcgcgggcaggtggcggttgacggcgttccacaaggtggactttggcgtggcggaggtgatcgagtgcatgaaggacggcaacgtggtgggccgcggcggcgccggggtggtgtacgcggggcgcacccggtcgggcggcgcgatcgcggtgaagcggctgcaggcccagggcggcgccggcgcgcagcagggcgacgaccgcgggttccgcgcggaggtccggacgctcggcagcatccggcaccggaacatcgtgcgcctgctggccttctgcacgaaccgggaggcgaacgtgctggtgtacgagtacatgggcggcggcagcctcggggtggtgctgcacggcaagggcggcgcgttcctggcgtgggagcggcggtaccggatcgcgctggaggcggcgcgcggctgtgctacctccaccacgactgcacgcccatgatcgtgcaccgggacgtcaagtccaacaacatcctcctcggcgacaacctggaggcccgcgtcgcggacttcggcctcgccaagttcctccggtgcggcgccacctccgagtccatgtccgccgtcgctggatcctacggctacatcgcccctggtacgtactgtactgtactaccataattatttattagatttcgtctctgctcctacatcaacatgaggtgccgctgccgacaatcagacggttaggattcgattggtctgtttagcaccacggtcgattatctggtggggggaatgggcgtgggtcccagacatcagggagaagtcaaaggtggtgtcagctagtgaacgtgtcaatggccactggtgattcgggacgggacgcgacagtcgcgcctcaagcagtgcgtcacgtaccagcgtagactagcttgcgtataagcgaggaatgattgagccattatggaatagcaagatcgggggtatatggctccatgccgctgcggcctctggagggcacacatacagtacgtaagacgtacgcgcacatgttgaaggccatgacacgtcagcaatgagtcgtgggcccggcatcgaaaacggccgaaaagaggtcctctgggcagactcgactcgggtccgcccgcactcgatcgcccaataattcccggcgcgggccccgcgtcgcgacgatggtgactggacgatgtgggcgcgggcccggcggtccgccctcgccgttcccagcccagcagcaaggtcatgcattgcacgcacaccacgcgatgccgatccgccccacgacagggcagcgcagtccctcggaagccgcgcatcggaacgcgcgccagggcagcgacatgctgcatgcacggcgcggtcctgtggcctgctgggccgcgtcggggctcccgtgtccgtgtaccgcctgtgtactgtacgtactccctggcactggcagggggactggcacgtcaaaccggaggtgtactgccggccggctggccgaccgtagtctgatagagtcagctcaggccgccagaccagagacgcgatgatggaggcgcggaccgcagaggagcagcatcgggcttgccaaactccaaaggccatcaatgtggctgcctgaagcctgggaacgcatgcatgtttgcagtgtcctgcatggtctcatgcatagtggtgcggtccagatgtgagatgtcttggccagccagcggttccaaattggaggtacacatacgctgtcactctcagtgcagtacagtagctgagacgacgaatcgagttttttcttttttagtccaagcaagaataccttgcgttttttccgtagccgcgagacacggctggcctttggtccctttccctttccttccctgctgtatctttgaccaccacgcaggcaatagcaccgagcccaacaaaaggcctcgtcgtccgcccgcggtcctccgcccgcttggggcttcgccaaagcggcgtgctccatgcaagcaacgtcgccaaagggacaagggccatgctttttcaactgcagaggcgcacatatacgccactgctgctgccgcgtgcagtcacgaactcttcttttctctctctctttctctctttggtaacagtgacattagcttcaatacactagtttatttttcggttcatgcgtgttcaaagataacgatttggctggtatatcgccttgcccaggcatggccgcatgggcatgcataatagacaaagattaattagggcagtctctgttgatccggatcggaccacgaattttccttgggtttgccaaaggtttagttttgtgaaagattccagtggattccttggatcgccattcctattggaattcgttgcggcgctttataggtcttgtcctctacgcacaggaccagctgtattaaaaaaacagcgcgtagctagatacaactgaatttggattcctatcttttaaagtgctaaattatgttactgttgctttataacctgcttaataattatatacctactgatcgtgcaagctctttctgacccccccaaaaaaaaacaaaaaacattccagagtacgcgtacacgctgcgggtggacgagaagagcgacgtgtacagctacggcgtggtcctgctggagctcatcacgggccgccgcccgtggggacttcggggaaggtgtggacatcgtgcagtgggcgaagcgggccacggccggccgccgggaggccgtgccgggatcgtggaccgccggctcgtcggcggcgcgccggccgacgaggtggcgcacctattcttcgtctccatgctctgcgtgcaggacaatagcgtggagcgccccaccatgcgcgaggtggtgcagatgctcgccgagctcccgcgccacgagtcgtcgccgtccacctcctcctcctcctcgtcgtcgtcggcggtggaaccgccaccaccgcaggccggcgaggagagcagccccgacgacgggaaggagccgccggccaactgctacaagctgttcccggacctgctggcctgataaactgaagcgcagacgacggaacctattttgctgccattgttacaagacacaaggctactactcaatcgtcgtgcagggctaaagttacagcatgtagtgcagaatggagctagacgttcaacaggttggtcggccgacattggaaatggtgacaagatagagctgggaatcaataacatgtaacttttttttgtctttcttcttcttctatctcctctccgaattattttctttttgttcatctatcaattcaaagctgtatagggtctgatcatatgctaccgcctatctagggattatgctgtccgagatgcagtagcatcccttccatcatcatagctttcgcacttttgtaatctcctggtaatctttagcc

SEQ ID NO: 233 - DNA, 3876 bp, Zea mays
cgcggcctcactcccttgtctccactctcccgacggagacggagctcgaacgaacccaatgccaatgcgcctcctcctcctcctcaccttcctcgccaccgccgccgcggtggcgggtgctgccggtggcgcggccgcggctggctcggatgcggacgcgctgctggcggcgaaggcggtgctgtcggacccggccggcgcgctcgcgtcctggacgaacgccaccagcaccggcgcctgcgcgtggtccggcgtgacgtgcaacgcgcgcgccgcggtcatcggcctcgacctctccggccgcaacctctcgggcccggtgcccacggcgctgtcccgcctcgcgcacctcgcgcgcctcgacctcgccgcgaacgcgctctgcggccccatcccggcgccgctgtcccggctccagtccctcacccacctcaacctctccaacaacgtgctcaacggcaccttcccgccgccgctcgcgcgcctgcgggcgctccgcgtgctcgacctctacaacaacaacctcaccggcccgctcccgctcgcggtcgtgggcctgccggtgctccgccacctccacctcggcggcaacttcttctccggcgagatcccgcccgagtacggccgctggcggaggctgcagtacctcgccgtctccgggaacgagctgtcggggaggattcctccggagctcggcggcctcaccaccctcagggagctctacattggctactacaacagctactccagcggcctacccccggagctcggcaacatgacggatctcgtccgcctcgacgccgccaactgcgggctctccggcgagattccgccggagctcgggaacctcgccaacctcgacacgctcttcctgcaggtgaacgggctcgccggcgccatcccgccggagctgggccggctcaagagcctcagctcgctcgacctgtccaacaacgcgctcaccggcgagatcccagcgagcttcgcgtcgctcaggaacctcactttgctcaacctcttccgtaacaagctgagaggcagcatcccggagctcgtcggcgacctgcccagcctcgaggtgctgcagctctggagaacaacttcaccggcggcatcccgcgccggctcggccgcaatggacggctccagctggtcgacctctcgtccaacaggctcaccggcaccctcccgccggagctgtgcgccgggggcaagctggagacgctcatcgcgctaggcaacttcctctttggctcaatccctgaaccactggggaaatgcgaggcactctcccgcatccgcctcggcgagaactacctgaacggttccatcccggaaggtctctttgagctcccgaatctgacgcaggttgagctgcaggacaacctcctgtccggcggcttcccggcggtttccagcaccggtgcgccgaatctgggggcgatcactctctccaacaaccagctcaccggcgcactgccggcgtccatcgggaagttctcaggtttgcaaaaactgcttcttgaccagaatgcattcaccggcgcagtaccgccggagatcgggcggctgcagcagctgtctaaggctgacttgagcggcaacacgcttgacggcggtgtgccgccagagatcgggaagtgccgattgctcacctacctggacctcagccggaacaacctgtccggggagataccgccggccatctccggcatgcgaatactcaactacctgaacctgtcccggaaccacctcggtggagagataccggcaaccattgctgcgatgcagagcctcacggctgtggatttctcctacaacaacctgtccgggctcgtgccagcgactgggcagtttagctacttcaatgccacatccttcgtcggcaacccggggttgtgtgggccgtaccttggaccatgccattctggcggcgccggcacgggccatgatgcacacacctatggcggcatgtccaataccttcaagctgctaatcgtcctcggcttacttgtctgctccattgcgtttgctgccatggcgatcttgaaggcccggtcactgaagaaggccagcgaggcacgcgcttggaggctcaccgcgttccagcgcctcgagttcacctgcgacgacgtgctagacagtctgaaggaggagaacatcatcggcaaaggtggagccgggatcgtgtacaaggggacgatgccggacggtgagcatgtcgcagtgaagcggctttcgtcgatgagccgtggctcgtcgcacgaccacgggttctctgcagagatacaaaccctcgggaggatccggcaccgctacatcgtgaggctgctcggcttctgctcgaacaacgagacgaatctcctggtatacgagttcatgcccaacgggagcctggggagctgctccatggcaagaaaggcgggcatctccactgggacactcgctacaagatcgccgtcgaggccgccaaggggctcagctacctgcaccacgattgctcgccgccgatcctgcaccgcgatgttaaatcgaacaacatcctgcttgattccgatttcgaagcacacgttgctgatttcgggctcgccaagttcttgcaggactctggcgcatcacagtgtatgtctgccattgcaggctcctatggctatattgccccaggtaaaccttttatccttattacagttcacagttgtctacagattagttctgaatacagctgatgcttgtttatctgatatagtggtaaacgtgttgctgtctgttactacttggcccattttagctaatgaaacatagcattcctttatttatggctcgctaaagtttgtttccttgttctgatatgtcagaaatatagaacttataatctacacgagtaaagaactcctgaaaataacctaatccttcatcggatcgctaccttgtgaatgtacagagtacgcatacaccctcaaggtggacgagaagagcgacgtgtacagcttcggcgtggtgctcctggagctggtcacgggaaagaagccggtaggcgagttcggggacggcgtggacatcgtccactgggtcaggtcgacgacggcgggcgcgagcaaggagcaggtggtcaaggtcatggaccccaggctgtcgagcgtgccggtgcacgaggtggcgcacgtgttctgcgtcgcgctcctctgcgtggaggagcagagcgtgcagcgccccacgatgcgggaggtggtgcagatgctcggcgagctccccaagccagccgctgccgctgccgctgcagctgcagggcaaggagacgaggttcccggcggcggcggcggcgacgacgaatgttccgccgcaccgtcgggtgctccggcagcggatggatctgttgaagcggcgcatggcgaagccaccaaagaaccgagctcgcagtcttcgccgaccactgatctcatcagcatctgagagctgtgtcgagcttgttttttttttccttcttcttctcgttgctatgtttccttccttctccttgcgaagttcagatgtttggatgtttctagattattagggtttggtgttttaggtctcacctgcacttagggtggtctctgagattcagacatcttgtgttcatccatcttcatttaggtaggccccgggatctgtggtgtgctgcatcttagcctcacttaggacactgctgtgtacagtagtacatatcaagctccctaaatctccattttgctgtcagaactgaaggaccatttaggggggggggggggggggggattaaggagcctaggatcatggagcagtcaagttagttaatgttctgtttgtacttgtttaataaggtgggctgcacttcgccttcaagcaatcaagcaagcc

SEQ ID NO: 234 - DNA, 4837 bp, Zea mays
gctgcgtccgcggtggcatcattgggagtccggactccgggctggacatggaccgtcggaaagacagggtccttcttcttggctgctgatttcgcgagcgctgccgccgccgcttcttcttcttcttcttcctccctgctgctgcggcggcggaattgtgcgttggagggctgtgggctggcgactggtctctccctcttctccggcttgttcgccgaattgaatctgcgggggttgcgttgcagcgatgcgggcgcggagccccggatgtggatgggtggtgctgggtggcgctcgctgctgtgctcgccttcatcctgccgccgtccaacgccacgctctcccctgccggcatcaactacgaaggtacattacctaccctacccttctcttcccatcgtctccgaagtcttaacaaaatgcccatcttttcgtattctgggaaggaaaaaaaaaagacatatggcctgatggccaacattttcaatcaggcaacacagttttttttcctgaaatctcgttgagaatcctctgccactctgtcgggttgggagttccctggtttcaaagatgatggtacaagatccgctatgcagaagaacattgagcggaatgaacctgatgtgcttttgcttcctcatcactcaccatgtctctcgacttttagctgtttcttggcaccacaaatttggtgtacctgaacctgccttgcctgtggctgaaccgcagtggtggctctgatggccatcaagacggagctggaggacccctacaacgtgctcgacaactgggacatcaactccgtcgaccctgcagctggaggatggtcacgtgctcctccgacggctacgtctccgccttgtacgtcacgctcccttgttcatgcccattctcaagagcaccggcggtggctcgatcttctcacatgcgttccttcgtttgcagaggactgcctagccagagcttgtctgggaagttatcacctggcatcggtaacctcaccaggctgcaatctgtgtaagttcacgcatcccctattgtttaccaatagctacaacacttcaaaattcaaaagttaaggtttccttagtggtccaatctggttgaatcaatcaaaatgctctgttttttgttgatcgacaggctgttgcagaacaacgtgatttctggacctattcccagtacgataggaaggctggggatgctaaagactcttgacatgtcagataaccagctcacggggagtatcccaggctcgcttggaaatctgaagaacctcaattatttgtaagattcttacttcaatcttgattttcaacactctcgctgatcacagtgatttcgttttggctcatttctagctctcgttgctaccaggaagttgaacaataatagcttgtctggagttctgcctgattcaattgccagcattgatggttttgctctcgtgtatgctctgcaatcccattttattgtttttttttgtcttccctatttcagtactgattcacttgagttggcttctgttatagagatctttcgtttaacaatctcagtggcccattacccaagatttctgcaagaacctttatgtaagtttttttcattttgatggacgaaatgatttcagcctgaacactgcatgctatgccagaattacagtttgcatagccacacattgattttattgtttgttcgtacagcatagctggaaatccaatgatttgtggtaataaatctggagatagctgctcttctgtgtcacttgacccactctcttacccaccagatgatctgaaaagtgagatctctttccattgttcaaatttgggaaggcgtaacagaagaaagtaaacaccttttcttctgggtggcactcactaatgtctccttttcctcagctcagccacaacaaggtattggaaggagccatcatattgctacaatatgtggagcaactgttggttcagtagcttttgtcgctgttgtagttggtatgcttctttggtggcgtcataggcgaaatcagcagatcttttttgatgttaacggtaatattcattttgatctgtttttgcgtgatcatgataacaaccacctaaatctagacgtgaattgcattagattagcttcttagttgcagcaacagctagcacattaagaatttatgatcttagagctttcgccttctgtcagcgtcagtcccactgtaaatttacatggatgtaaagtgttgttagtcaatttgagctacaggagttgcaataagttgaatagcacaagagacttgatagttttcgctttcagccatgtggcattaataaagagtttcagaatcaccacaaatttgaatataaaatagatgcacctggtacatagttgtgtgggttagtaactttgtgccatagacattaggaggatacatcataaaacttatgttgcttttttgtttttacttgtatgatctcccagttacttttgggcttggcatatgggctatttcataatcatgatttcctagttactttatgtacactttctaacctttcattggttcagggtattttttttatcttacctttctagacctgctttgatctttttagcattctataatgactgtcctccgtttgcatgctatgatagctgtctttacagcagcagcctaattgaacctgatacattcttcaacgtgcagatcaatatgatccagaagtttgtttgggtcatctaaagcggtatgctttcaaggagctccgtgcagctactaataattttaactcaaagaacatcttaggtgaaggtggatatggcatagtatacaagggttatttgcgtgatggctctgttgttgctgttaaaaggctgaaggattataatgccgtcggtggggaagttcaatttccaaactgaagttgaagtcataagcttggctgtgcatcggaatctcctccgtcttattggattctgcactacagagagcgagaggttacttgtttatccatatatgccaaatggaagtgttgcttctcaattgcgggttagtcactcttctagcccatgactttgatgtgcatatgctgttgcgagcaggtccagttttttaagcatgcaaagtctaaaaattctattgttgtcacaagaggcggaaaatggctaaaacaatacttaagtaaaatgtttatggatgcatcatagttcatgtgaaatgtgtcagctttccaacacgtgcttattagcgtttctgcatagtgcatagagtactaaacttagttttgtgttgtctggactataccatacgctttctacaaacaggcaagctagcttgatatatattggtgtgttgcagatggtctttgcatctactcatcactacgtgctctatattgtcaaccatgtaaacccgaattaacgttcttccattttattcagaacatataaacggcaagccagctctagactggccaaggagaaagaggatagcgctaggcacggcacggggcctgctctaccttcacgagcaatgcgacccgaagataatccaccgggacgtaaaggcttccaacgtgcttctcgacgagtacttcgaagcgatcgtgggagacttcgggctggcgaaactcctggaccacagggagtcccacgtcacgaccgcggtgcgcgggaccgtcggacacatcgcgccggagtacctgtcgaccggccagtcgtcggagaagaccgacgtgtttgggttcggggttctgttagtcgagctgattactgggcagaaggcgctggatttcggaagggtggcgaaccagaagggtggagtgctcgactgggtaagcatgcagcttgtgtttactttacttgtccgatttcaggtttgctttgaaacttcaaaatgaagaacgtctgtctgtctgtctttcctctatcatacatacattgcaagctttctgtctgtattgtgccatgaacacgttctcctcgtcctggtcggtggttcccaggtgaagaaactccaccaagaaaagcagctaggcacgatggtggacaaggacctgggcagcagctacgacagggtggagctggaggagatggtccaggtgtccttgctgtgcacgcagtaccacccgtcgcaccggcccaggatgtccgaggtgatcaggatgctggagggggacgggctcgcggagagatgggaggcgtcgcagaacgtggacaccccggagtccgtctcgtcggagctcctgctccagaagtacatggacttcgcagcggacgagtgctcgctcggcctggaagccatggagctctccggcccgaggtgaccgtaccgacgggctggttgaccggacccggcgggcatcgcacgggtcggcgtaggtgtttttgccgtatcaagccctatattgttgtgttacgttggacacatagggaaggcgatggattgtatggtctatatagctgtggtggcattcatttgtacatacagcagcattgtgtgaggtgagcccatccttgttgcgcgtctacttggtggcaaagagatgaagatgaatgagtatatagagatagagatcaaagttcccagtgcggagcggttggtgcctgtttgtgttttctgctttgctgaaaggcaaggcgtgcgcagcgctgtctgacatgcgccactgcttgtaaaacagcggtccgttacgcattccggagaggatatggtagatacagacgtggtattaggggttcacagaatctgtttctgtgtgtttggttcatgactgttttttactgtactgagaacttgctcgtttcaccgttgatccatatggatcgaatagtattaagtcggttt

SEQ ID NO: 235 - DNA, 3498 bp, Zea mays
ctcactccccctctctaccgccgccattcacctaccaacaagtgcgtgtgtagtgagaaagaaaccttattggctagctcgccggccggcagcttcaccatccaatacagcgaggagcaagctctgctctccgaacccggccacccatggctctcgacctcgtcgtcctcctcctcctgcccatcttccttctctcatcgtcttcctgcctcgtcctcgccattccaacgctagccagccaggctgccaccctgctctccctcaaggactctttctcgcctccgctcccgccgcagctgcgcagctggaccctcgccaactatgcctcgctctgctcctcatggcccggcgtcgcctgcagcaaccgcaccgtcgtctcgctcgacatctccggctacaacctctccggcacgctgccccccgctatcgccgacctcgctggcctccgtttcttctccgccgccgccaactccctctccggagacattccgcccgccatcgccgccctccgcgacctccgccacctcaacctctccaacaaccagttcaacggcaccctggacgccctcgacttctccgcgatgcacagcctccaggtgctcgacctctacgacaacgacctcgccggcgcacttcccaccctcctccccgcggccgcgggcctccgccacctcgacctcggcgggaacttcttctccggcaccattcctcccagcttcggccgcttccccgccatccagttcctctccctcgccggcaacagcctctccggggacatcccgcccgacctcgccaacctctccacgctgcgccacctcttcctcggctacttcaaccgcttcgacggcggcatcccggcggagctcggcaggctcaccagcctcgtccacctcgacctcgccaactgcggcctgcagggccccatcccggcctcgctcggcgacctcaccgggctggacacgctctacctgcagacgaaccagctgaacggcaccatcccgccgtcgctgggcaacctcaccggccttaggttcctcgacgtctccaacaacgcgctcacggggagatccctcccgagctcgccgcgctcagggaactcaggctgctgaacatgttcatcaaccggttccgcggcggcgtcccggacttcctgggcgacctccgctccctgcaggtcctcaagctgtggcagaacaacttcacgggcgccatcccgcggcgctcggccgcgccgcgccgctccgggaggtggacctgtccacgaaccggctgacgggggaggtgccccgctggctgtgcgcgcgcgggcagctggagatcctcatcctcctcgacaacttcctcttcgggccggtgccggaggggctgggcgcctgcccgacgctcacgcgggtgaggctgggccagaactacctcacggggccgctcccgcgcggcttcctctacctgccggcgctcaccaccgtggagctgcagggcaactacctgacgggacggctggaggaggacggcagcggcagcagcaggctgtcgctgctgaacctgtcgagcaaccgcttcaacggatcgctgccggcatccatgggcaacttctcgtggctgcagacgctcctcctcggtggcaaccagctgggcgggcagatcccgcggcaggtcgggcgcctgaagcggctgctgaagctggacctgagcggcaacaagctgacgggggcggtgcccggcgaggtgggcgagtgcacgtcgctgacgtacctggacctgagcggcaaccgtctgtccggcgcgatccccgtgcggctggtgcagatcaaggtgctcaactacctgaacgtgtcgtggaacatgctgagcggcagcatcccgcgggagctgggcggcatgaagagcctgaccgccgccgacttctcgcacaacgagctgtccgggcgcgtgccggagagcgggcagttcgcctacttgaacgggtcgtcgttcgtgggcaacccggggctggtggtggtgaatccgaagcagcaggtgatgggaggagggccggggatcctcggcggcgcggggacgcaggatgaacgtggctcttcttcgtcgtcggcggtgatggggcgcctgaagctgctgcttgcggcggtgggcctccttgggttctccgtggcgttcgcggcggctgccgtggcgacgacgcgttccgccgccatgctccggcggcggcgtcggtcttcgtcgtggcggtggcgcatgacggcgttccagcaggtgtctttcgggtgcgaggacgtggtgcggtgcgtgaaggagaactgcgtggtggggcgcggcggggccggggtggtgtaccgcgggacgatgcccggcggggagtgcgtggcggtgaagcggatcgtgtcggcggagggcggcgggttccaggcggaggtggagacgctgggtgggatccggcaccggcacatcgtgcggctgctggccttctgctcggggcccgaggcgaagctgctggtgtacgagtacatggtgaacggcagcctcggggaggcgctgcaccgcgctgatgatggcggcggcggtgtggtgctgtcgtgggcgtcgcgtctccgcgtggcgacggaggctgccaaggggctgtgctacctgcaccacgactgctcgccgccgatcctgcaccgggacgtcaagtccaacaacatcctgctggacgcgcgcatggaggcccacgtggcggacttcgggctggccaagttcctgggcggcagcggcgcctccgagtgcatgtccgccgtcgcaggatcatacggctacatcgcaccaggtacggtacaatacaatacaatgacgtgatggtcatggtggtgtggtggtccagtccagccagcagccgttgtttgtcttgtctgcaattctgcattgcatacccccacacagttctcgaaagaagagctcgctttgcatgcatgcatggccccggccgcagcactagcactagcactgcatgcatgcgttttatactatagtattcaaatgcatgcatgcatgcatgcagagtacgcgtacacgctcaaggtggacgagaagagtgacgtgtacagcttcggcgtggtcctgctggagctcatcacggggctgaagccggtgggggagcacctcggcgacgacgcggtggacctggtgcagtgggcgcgcgcccggagctctgcagggggcggcgtcctggcgctgctggaccctcgcctcggcggcgacgtcccggtggcggaggcggcgcatgtgctgttcgtgtcgatgctatgcgtgcaggagcacagcgtggagcgccccaccatgcgcgaggtcgtccagatgctgcagcaggcacggcaccagcctagctaggacgacgaccggagaaacgatgtgaaaatgtgatagatagacagaggtggtgttgtgtacgttgtcattgcattcggtaactatatatatatatatttttagcagaaggtcagctgtaaattaaaaatatgacctgac

SEQ ID NO: 236 - DNA, 4245 bp, Zea mays
acaccgccccaaaagaataaaaaaaatcattttgctcttttgattgattgatatgctatagctggagttcaaaccaacaggccacaggctacaggccacagctagcacacccttctcgccacgctcttgtccgcactctactcgccgagagtgtgagtcgagacgcctctctcgccctctcttctcctccctccactccgccgccgcgcccgagaaaagagagttccaatgcgcctcctcccgctgctcctgctcctgtccctcgccgctgtcgcggccggcacggacgcggacgcggacgcgctgctggccgcgaaggccgcgctctccgaccccactggggcgctcgcgtcctgggacgcggcctcctccgaccattgcgcgtgggtgggggtcacctgcgcgccccgcggctccggcggaggcgtcgtcgtcgggctcgacgtctccgggctcaacctgtccggcgcgctcccgccggcgctgtcgcggctccgcggcctgcagcgcctctccgtcgccgccaacggcttctacgggcccatcccgccgtccctcgcgcgcctgcagctcctcgtccacctcaacctctccaacaacgccttcaacggctcttcccgcctgcgctcgcgcggctccgcgcactccgggtgctcgacctctacaacaacaacctcaccagcgccacgttgccgctcgaggtcacgcacatgcccatgctccgtcacctgcacctcggcggcaacttcttctccggggagataccgccggagtacggccggtggcctaggctgcagtaccttgcggtctccgggaacgagctctccggcaagataccgcccgagctggggaacctcaccagcctcagggagctctacattggctactacaacagttacaaccggtggccttccgccggagctggggaacctgaccgagctcgtccgcctcgacgccgccaactgtgggctctccggcgaaatcccgccggagctcgggaggctgcagaatctggacacgctcttcttgcaggtgaatggcctcaccggcagcataccgtcggagctgggctacctcaggagcctcagttctttggacctgtcgaacaatgcgctcaccggtgagatacctgcgagtttctccgagctcaagaacctgacgctgcttaacctgttccggaacaagttgcgcggcgacatccccggcttcgtcggcgacctgcccagcctcgaggtgctgcagctgtgggagaataacttcaccggcggtgtgccacgccgcctcggccgcaacggccgcctccagctgctcgacctctcgtcgaacaagctcaccggcacgcttccgccggagctctgtgcggggggcaagctgcagacgctaatcgccctcggcaacttcttgttcggtgccatcccagactcactcggccagtgcaagtccttgagccgtgtccgtctcggggagaactacctgaatggctcaattccgagggtctattcgaattgccgaagctgactcaagttgagttgcaagataacctcctcactggcaatttcccggctgtgatcggtgctgcggctcctaaccttggtgagtagcctgtccaacaaccagcttacgggtgcattgcctgcatctcttgggaacttctctggtgttcagaagttgctgcttgatcagaacgcgttctctggtgccatacctccggagattgggcggctgcagcagctctccaaggctgaccttagcagcaacaagtttgagggaggtgtgccaccggaggtcgggaaatgccggcttctcacttacttggacatgagccaaaacaacctctctgggaagatacctccggccatctctggaatgcgaatactgaacctgaacctgtccaggaaccatcttgatggagagatacctccatccattgcaaccatgcagagcttgacggcggtggacttctcgtataacaacttgtctgggcttgtgccagggactggccagttcagctacttcaatgccacatcttttgttggcaatccaggcctgtgtggaccatacctcggtccatgtggtgcaggcataggtggcgccgaccactctgtccatggccatggctggttgaccaatacggtcaagctgctcattgtccttggcttgtttgatctgctccattgcattcgctgtggcggcgattctgaaggctcggtcattgaagaaagctagtgaagctcgagtatggaaactcactgcattccagcgcctagacttcaccagcgatgatgtgctggattgcttgaaagaggagcacattattggcaaaggtggtgctgggattgtgtataaggggcgatgccgaatggtgaacttgtggctgtgaagagactcccagcaatgggccgtggctcatcacatgatcatgggttctcggcagagatacaaacacttggtagaattcgacaccgtcatattgtgcgcctgctaggcttctgctcaaacaatgagactaacctgttggtttatgagtatatgcccaatggcagccttggggagatgctccatggcaagaagggagggcacctccactgggatacccgatacagcattgctattgaggcagccaaggggctttgctacttgcaccatgactgttcacctttgatacttcaccgggatgtcaagtcaaataatatacttcttgactccaactttgaagctcatgtggccgactttgggctagcaaaattcttgcaggactcgggggcatctgaatgcatgtctgccatcgctggctcatatggctacatagcgccaggtaaaaacaaacccttcctgatccagcttaatatgaatactgtactcatctgaatctgtggagatgcaccgtaagtttagaatgcttatagttattacattgttcaagctataaaactgtctctcaagctataaacctttattgttatactgttttgatgagtattggtgcttatctacatggtttctgttgtaatattctctctgctagttctccttgacatttactgaaagaccaattacttcattgttgtatcttatgtttaaaatttacaatgtctgtttacaccttcaggattgtaatgttcaatgggtttttatgtgtatcttactgctgtatctcgctttatatctacattgattttggtttacacagtctggctattggcttctaaattctagtattctttttttctttccaattgactaacctctgctcttcgatgccacccgtggctacccagaatacgcatacacattgaaggtggacgagaagagtgatgtctacagcttcggcgtggtgcttctggagcttgtcacaggaaggaagcccgtaggcgagttcggcgacggcgtcgacatcgtccagtgggcgaagatgacgacgaactcaaacaaggaacaagtgatgaaggtcctggacccaaggctctcgaccgtcccgctgcacgaggtgacgcacgtcttctacgtcgcgttgctgtgcaccgaggagcaaagcgtgcagcgcccgacgatgagggaggtggtgcagatcctgagcgagcttccaaaaccgccatctaccaagcagggagaggagaattctaccaagcaaggagaggaggttccgaattccggcgacggctctgcgcccagccctctacactcagcaccagttgggaccaacgaagcaccagccgtcgaagcgagagaccaccagcagcagacaagctctccgtcgtcgccaccgcctccagatctcatcagcatctgagtaaccggaatcgaaaacgttaccgttcctcgcaaaaatccccgcttcagtgtagcaagcttaggtcgtaattttaggtttgcaataagtttatttggcctcctgtgctgtacatatccgagtttgtttgttggttggttgtgtccggtctgtcatgtttcatttgctggtgcggtgtggtaggagtctgtagcgagttgagtttgagtgagccacgttgctagagcctttgatttcccttctctaatactagtgcactctctcttgtcaaatttggcgccagaatctttgttgtggaaccaaaaaccttaaagtgctttctacttctgtgtaaacggtgggagtgggccataggcccatagctaaaggcctcgaaatcaccagaccttaggctgtattggttggtcccaaagagaaagcctgcttgcaaggtgaattgattgattggtacaccc

SEQ ID NO: 237 - DNA, 4538 bp, Zea mays
aggtcaggtgagaaccgagaggcacctcctccctgtcattatcctccctctccctccccagtccctcctactaaagacacattgccccggttgtttatcgctcccaccagaactcccacttccctagctatttgtccaactgcccatcctttggagaattcttttgtggcaagaatcgccaatcagttgaaagttgccgttgtcagtcgtgatctgtcatagtctttgctccactgcaacacacccacactccaataaagctggtgtctttcttgagtgggatcaataataatctataaactttggactagattagactaggcaccttaagttagccgtcactgtttttcataacctggtttcgttcttcacaggtcccaagaacgcaaaaggaaggaagggtgagaggggagagagtaaggaggaattttcttgcctcctttgctgtaatttttctattccaaacaggctcaggtggcaggcatgtttgtcccctccaccccctcggccccggcccttgctcctccccctccttttgttttcctgctttgcttgcggccagagcacaggcatcttcttttggtcatttgcttgctacactgacaggttctcagagcagaggcatccggcacccctggtaggcttccactgccactgagaatttggttctgggaagagagaaaggctgcacgattcttcctcaccttggcctcactcttgcttccatgcttgacattgaacacggagcaagctcctgaacttgttgccgaggaggccacactcttgcgctgccttggcaatgggggaggttgttgctgcttcctccctggccctggtgctgctcttcttctgctcttgcgggcctgcaagcggccttctctcccccaagggtgtaaactatgaaggtcaatattccgtcccaaatcaagaggcatcttgtttatttttgtgtttgttctctttcgttggtccttgtaatcatccctgtgatgctctcagaccaaacaactctgtgaaagaaatatttgtctattcgtttttccctttttgctacattgttgcagtgagtctctcctttgtttgcagttcaagctctcatgatgatcaagaactacctcaaggatcctcatggtgtactgaagaactgggaccaagactctgtggatccttgcagctggacaatggtcacttgctctccagagaaccttgtcaccggcttgtaagcaagccacctaccatttgtgtgtgttccagctcaatcaatgtttcctctgtatcttattgtttctgtggctatttccatttggcagagaagcaccaagccagaacctttctggaattctctccccaagtatagggaatctgaccaaccttgagacagtgtaagttttgctgccaagattagcttcgttaatttctatgtttactatgtttattggggcaagaggagatctcattttttgtatatttatagtcttctgcagaacaacaacataaacgggttaatcccagcagagattggaaagctaagaaagctcaaaacgcttgatctgtccagcaaccacttctctggagaaatcccaagctctgtgggccaccttgaaagccttcagtatttgtgagtgcaattctgctccactgtactagctttgaacagttggaagtttgttccaccgtacttgtcttgaatgctattctggaggttttctattcatgtcctgttgttcctcaggagacacaagtgtctattcttacttttaattactccaacattgtgctgttactaggaggcttaacaacaacacattgtctggtgccttcccttcatcatcaactaatttgtcacaccttattttcctgtgagtactcattgcttgttttgctgttgtgatatgtgtcttgtgttggctatgtggtgatcattgatcactgttaacttgcatttctctcagggatctgtcatacaataatttgagtggtccaatcccagggtccctgacaaggactttcaagtaaggctatagcctgctgttatttatcttgatcaaaatttccacttccactgaaacatatttacctccaaattttgagttaccaggaatagtattcacaccattcgcttgcagcattgtagggaatccactgatctgtgcagcaaccatggaacaagattgttatgggtctttacctatgccaatgtcttacggactgaataacacacagggtatgcagaatcaatcagttcatgatgctagcaattatattaaagacacttgtgctcaattagcgcagatattcaagtataattttgtacgtagttagcaaattgatctaatgacaatttttatctaaaggaactgtgattcctgcaaaagctaagagccataaagttgcaattgcatttggtgctacaactgcctgcatcagccttctgttccttgccgttggttcactattctggtggaggtgtaggcgaaaccggaagactcttttcaacgttgatggtaggtaaaatgctcaagttactaatcaattcatgaactcagtattttgatcgtgagtcttgacggtatcagttaccatactgtattggctactgcagatcatcagcacatagagaacggcaacctcggaaatatgaagcggtttcaattcagagagctccaggctgcaacagaaaacttcagcagcaagaacatattaggaaaaggcgggtttggtattgtttaccgggggcagcttccagatggaagtcttgtagccgtcaagaggctcaaagatggtaatgctgcaggcggggaagcacagtttcagactgaagtcgagatgatcagcttagcagtgcacaggaacctcctcagactctatgggttctgcatgactgccagtgagaggctactggtctatccgtacatgtcgaatgggagtgtcgcgttgcgcctgaaaggtaagcagttttcaagttatgaatgcactagtcaccagtgtcacgtgcttttctttgttgaagattaatttttctcaagtaaatgtatatggaattaaacatgactgcttgattttctttttccgaacaatgtgactgcttgatataattgatgacagaacctatccaagctatgaagcagaataaaagaagatttacaatttgattctttcgttccgtttcctctcctttgggcagaatattagacaaacaatacgattcccttataaccaaaacattaattttttccctcaccaactcaaactacagggaagccaccactggactggatcaccagaaagaggatagcacttggggcagcacgaggtctactttatctgcacgagcagtgtgatcccaagatcatccacagagacgttaaggcagcaaacatactgctagatgactgttgtgaagcaattgtcggggactttgggcttgcaaagctcctagaccaccgtgaatcgcatgtcaccacagctgtgcgcggaactgttggccacatcgctcccgagtacctctcgactggccagtcatctgagaaaacagatgtctttggttttggaattctgctgctggagctgatcactggtcagactgcactggagtttgggaagtcatcaaatcagaagggagccatgttagactgggtaagttaattcagtaccattttaatatggtctacacaacttgtggcatatgatcatacctgagataacagacattgatgctgttcaggtgaagaagatgcaccaagagaagcagctggacatacttgtcgacaagggcctggggagcaaatatgaccgcattgagctggaggagatggtgcaagtagcactgctatgtactcagttcctccctggtcacaggcccaagatgtcagaggtggtccggatgctggaaggcgatggacttgcagagcggtgggaggcgttacaacacactgagtcacacaaattcaaggtgcctgagttctccttcagccgctgccactctgacctgacggacgactcgtcactgttggtgcaagcagtggagctttctgggccaagatgacaccaacggagacggtctgtggcaagaagtatccagcagttgtttcccagtagaaaatgtaaataatacaaagtgaagcaactggtgctgcatcctgtcagaagtcgaagcaaatctcaatcagctgaactgtacaaagattaaaaaaagagcacaacctagtctaagcatggtacattactacatctacagattatgtaactgttggtagaataaggatagagcaatgtttccattttgtttgttattttcccctttgtattctattactgtagttatagtttgtaaaatgcaaaaacggtggcaatagcgctcgatgttggtgctgaagaactcaaatagcttagtaaagaccaagtgtagacaggtgccaacgaagaatttgattgtgtgcatgaacttcctacctccgttgccaacacatactgcaaagaaagcaggtataattcctagccatgacggcattttttgcatgatataaaatatttggtat

SEQ ID NO: 238 - DNA, 4034 bp, Zea mays
ctaagggaaacccacgcaacaccccaaaagaacaaaagaaaatcaactttttttgattgatatcctatagtttatcgagcgttcaaacccacaccaagcacaactgcacaacccctcggccctcgccacgccacgcacttgtccgcactctcctcgccgagagtgtgagccgaaccgcctctcgccctctcttctccctctccaatccaccccgccgccgcgcccgagaaaagagaagcccaatgcgcctcctcccgatgctgctgctcctggccctcgccgcgggcgcggctggcgcggcgggcggcagcacggacgcggacgcgctgctcgccgtgaaggcggcggtctccgaccccaccggtgcgctcgcgtcctgggacgccgcctcctccgaccactgcgcgtgggtaggggtcacctgcgcgccccgcggctacggcggaggcgtcgtcgtcgggctcgacgtctccgggctcaacctgtctggcgcgctcccgccggcgctgtcgcggctccgcggcctgcagcgcctctccgtcggcgccaatggcttctacgggctcatccgccgtctctcgcgcgcctgcagcttcttgtccacctcaacctctccaacaacgccttcaacggttcctttccgcctgcgctcgcgcggctccgcgccctacgggtgctcgacctctacaacaacaacctcaccagcgccacgctgccgctcgaggtcacgcacatgcccatgctccgccaccttcacctcggcggcaacttcttctccggagagataccgccggagtacggccggtggcccaggctgcagtaccttgcggtctccgggaacgagctctccggcaagataccgcccgagctggggaacctcaccagcctcaaggagctctacattggctactacaacagttactccggtggtcttccgccagagctggggaacttgaccgagctcgtccgcctcgacgccgccaactgtgggctctctggcgaaatcccgccggagctcgggaggctgcagaatctggatacgctcttcttgcaggtgaatggcctcaccggcagcataccgtccgacctgggctacctcaggagcctcagttctttggacctgtcgaacaatgcgctcaccggagagataccggcgagtttctccgagctcaagaacctgacgctgcttaacctgttccggaacaagctgcgcggcgacatccccgacttcgttggcgacctgcccagcctcgaggtgctgcagctgtgggagaataacttcaccggcggtgtgccacgccgcctcggccgcaacggccgcctccaggtgctcgacctctcgtcgaacaagctcaccggcacgctgccgtcggagctctgcacgggggcaagctggagactctcatcgctctcggcaacttcttgttcggtgccatcccaggctcactcggccaatgcaagtccttgagccgcgtccgcctcggggagaactacctgaatggctcaattccgaaggggctattcgaattgccgaagctgactcaagttgagttgcaagataacctcctcactggtaatttaccggctgtgatcggtgctgctgctcctaaccttggtgagatcagcctgtccaacaaccagcttacgggcgcattgcccgcatctattgggaacttctccggagttcagaagctgcttctagatcagaacgcgttttctggtgccatacctccggagattgggcggctgcagcagctatccaaggctgaccttagcagcaacaagtttgagggaggtgtgccagcggagattgggaaatgccggcttctcacttacttggacattagccaaacaacctctctgggaagatacctccggccatctctggaatgcgaatactgaactacctgaacctatccaggaatcaccttgatggagagatacctccatccattgcaacgatgcagagcttgacagcggttgacttctcgtataacaacttgtctgggcttgtgccatggactggccagttcagctacttcaatgccacatctttcgttggcaacccaggcctgtgtggaccatacctcggtccatgcagtgcaggcattgctgggggcgaccatactgcccatgaccatggtgagctgaccaattcggtcaagctgctcattgtgcttggcttgttgatttgctccattgcatttgctgctgcggcaattctgaaggctcggtcattgaagaaagctagtgaagcgcgagtatggaaactcactgcattccagcgcctggacttcaccagtgatgatgtgctggagtggttgaaagaggagaacattattggcaaaggtggtgctgggattgtgtataagggggcaatgccgaatggtgaacttgtggctgtgaagagactcgcagcaatgggccgtggctcatcacatgatcatgggttctcggcagagatacaaacacttggtagaattcgacaccgtcatattgtgcgcctgctaggcttctgctcaaacagtgagactaacctgctggtctatgagtatatgcccaatggcagccttggggagatgctccatggcaataagggaggacacctgcactgggatacccgatacagcattgctattgaggcagccaagggactttgctacttgcatcatgattgttcgcctttgatacttcaccgtgatgtcaagtcaaataacatacttcttgactccaacttcgaagctcatgtggccgactttggtcttgcgaaattcttgcaggactcaggggcatctgaatgcatgtccgccatagctggctcatatggctacatagcgccaggtaaaaaccaacccttcctgatccagtcaatctgaatagagtactcatttgaatatattggtatgcgtcataagtttagaatgcttgtatttactagtacattgttgaagctataaaactatctctcaagctataaaacttcattgttgtaatgattattggtgctcttctacatggtttctgttatattctctctactagtcctctttagcattttgaagatcggttacttcattgttgtatcttctgttgaaactttatgatgtccgtttaccgcttcaggattgtaatgttcaatggttttttatgcatatcttcttttatctccttttgtattttctctttacatctacgtcattgcttttggtttacaaaatgcctgggctattagcttctaaattctatctcccaactgattggccttgctctttgttgttgtcacctgtggctatccagaatacgcatacacactgaaggtcgatgagaagagcgacgtctatagcttcggcgtcgtgctacttgagctcgtcaccggaaggaagcctgtaggcgagttcggcgacggcgtcgacatcgtccagtgggcgaagctgacgacaggctcgaaaaaagaacaggtgatgaggatcctggacccaaggctctcaaccgttccgctgcacgaggtgacgcatgccttctatgtcgcattgctctgcaccgaagagcagagcgtgcagcgcccgacgatgagggaggtcgtgcagatcctgagcgagtttccaaggccatctagcaagcaaggcgaggaggctccagattccagtgacggctctccttccagtcctttacatccagcaccagttgggtccaatgaaacgccaaccgccgaagcgagagagcagcagcagcaaacaagctctcggtcatcgccaactccagatctcatcagcatctgagtaaccaaatctgaaaactttaccattgcgaaatccacgcgtcagtctagcatgcttaaaggtcgtaatttaggatgcggtaagtttggtctcctgtgctgtacatattcatgtttgttgtttccagtttgccttgttttcatttgctgctgcagtgtaggagtctgtagcgagttgagttacattgctttgagcctctgatttcccagtaggcactaaagtgtaagggcactctttgttgtcatatttagtacc

SEQ ID NO: 239 - DNA, 4364 bp, Zea mays
atggggtggtggtggcgcctgccggtcgctgctctgctcgccgcgatcctgccgtcgtccgacgccacgctctcccctgccggcatcaactacgaaggtaccgtacctacccaggctaccctgctcctctcctcgttcgtttcccaagtcttaacaaaatgcccacacttattttttggaataaaagatacacatacatggccaatattttcaatcaggcaacgcagtttttttttttggctcaaatttgttgaaaaaccttcactctctcttttggcatcaatctggtttcaaagatgatctaaaaaggtccactatgaggaagagcattaaacgaagggaaaatgtaacgtacctgctgtgctcgtgcctcctccagtcctcctcctcctcatgtctgtcgagttgttagctgttcctttggcaccacaaaattcggtgaagctgaactgtggctctgaaacgcagtggtggccctgatggccatcaagacggagctggaggacccctacaacgtgctcgacaactgggacattaactccgtcgacccctgcagctggaggatggtcacctgctcctccgacggctacgtctccgccttgtacgttacgcccccctccccccttgttcatgcccacattctgaagaacaccggcagtggctgctttgggccgatcttctcacttgcgtcccttcgtttgcagagggctgcctagccagaccttgtccgggaagctatcacccggcatcggcaacctcaccaggctgcaatctgtgtaagtttagtttgctcacccgctattgtttacccatagcactaacgcttcaaaattcaaacttgaggtttccctagtggtccaatctggttgaatgaaccgaagcgctctgttttgctgatcgacaggctgttgcagaacaatgggatttccggccctattcccggtacgataggaaggctggggatgctgaagactcttgacatgtcagataaccagctcacggggactatcccaagttcgcttggaaagctcaagaacctcaattatttgtacgattctaacttcaatcttgatcttcaacactctcgctgatcgttgtgatttcgttttggctcatttctagctctcttgttgctaccaggaagctgaacaataatagcttgtctggagttctgcctgattcacttgccagcattgatggttttgctctcgtgtatgctctggaatcccgttttattgtttctttttctctttccctatttcagtactgattcactttagttggcttctgttatagagatctttcgtttaacaatctcagcggtccattacccaagatttctgcaagaacctttatgtaagtaattttaattttattccttttcatagctgaaatgatttctgcctgaacactacatgctatgccaggattaatgtttgcatagtcacgctttgattttattgtttgtttatacagcatagctggaaatccaatgatttgtggtaataattctggagataagtgctcttctgtgtcacttgacccactctcttacccaccagatgatctgaaaagtgagatctctttccgttgttcaaatttggggaacagaagaaaataactaccttttcttcttggtggcactcacatatgtctccttttcctcagctcagccacaacaaggcattggaaagagccatcatattgctacaatatgtggagtaactgttggttcagtagcttttatcgcttttgtagtgggtatacttctttggtggcgtcataggcgaaatcagcagatcttttttgatgttaatggtaatgctcttttttattctgttcccgtaagatcatgataacaaccacctagatcttgatgtgttgcattagattagtttcttagttgcagcaaccgctggcactttaagatcttagagatttcaccttctggtcaatcccacagtaaatttacatgaatgtaagtgttgttagtcaatttgagctacaggtgtttcagtagactgaatagctgagttgtttccccaatagcactcagagacttgagaattgtttttttttttcagccatgtggcattgataagaagtttcacaatcactcgcaaatttgaacataaaatacattctcctggtaacattagttgtgtgtgctagaaacttagtgccattggcattaggactagcataaaacttatgtagctttttagtttttacctgtatgatctcccagttacttttggactttggcgtgcggcctatttcgcaatcatgatctcctagttactttgtctctttctaaccttttaatgatcatgaggtatttttatcttacccttctatactcgctttgatctttttagtattctatataatgcttgtcattctcttgcatgctatgttgtttgtttttgcagcagaatggtaattgaacttgatacattattcaatgtgcagatcaatatgatacagaagtttgtttgggccatctgaagcggtatgctttcaaggagctccgtgcagctactaataattttaactcaaagaacatcttaggtgaaggtggatatggcatagtatacaagggttatttacgcgatggctccgttgttgctgtcaaaaggctgaaggattataatgccgtcggtggggaagttcaattccaaactgaagttgaagtcataagcttggctgttcatcggaatctcctacgtcttattggattctgcactacagagagtgagaggttacttgtttatccatacatgccaaatggaagcgttgcttctcaattgcggggttagtcgctcttcttgctcttgacttccatgtccatatgctgttgcaagctggaccaattttgaaagtacactggtccagaaaatgcattttttgtcacaagagggggaaagtggctataaaaaagcaattataaaaatgtccactcagaaaacctttgagtggtaaaacggctatcaaagcctgatgaaaattttgaatttaaaaatgtgttaacacttctgcatatctgttaaataagtttcttgtatctaacataaaatagttaccctatttctggatgcatcatagttgatgtgaagcgtgttggctttccaacatttgcttagtgcttctgcatagtgcattgagtagtactaaatttagttttgtgtggtctaggccacaccttatgctttgtacaaacaagcaagctaccatgatttctattggtgtgttgcagctggtctatgcatcacagttgttgtccttccattgaacgccgttgaattaattatgtcgatcaaatcaaaccctactcatgttcctgctgtggagctctgccataacgttgtatgtccatgtgatatattgctttcaagtccagttttggactgcccaatctctatctgtcctcaactcaagccgtgtggtatcaggttaattgatagcagcaaaacaccatacaagggcctcgcccacgtatgctgtccaccatgcatgcaaattaactctcttccattttatccagaacatatcaatgccaagccggctctagactggtcaaggagaaagagggtagcgctaggcacagcgaggggtctgctctaccttcacgagcaatgcgacccgaagataatccaccgagacgtgaaggcctccaacgtactcctcgacgagtacttcgaagcgatcgtgggggacttcggactggcgaagctcctggaccacagggagtcccatgtcacgaccgcggtgcgcgggaccgtcgggcatatagcgccggagtacctgtcgactgggcagtcgtcggagaagaccgacgtgtttgggttcggggttctgctagtcgagctggtcaccggacagaaggcgctggatttcggaagagtcgcgaaccagaagggcggagtgctggactgggtaagcatgcatcagcatcttgtgtttactctgcccttcagttcagtctctgtttgcatcgccatgaacatgcatgtcctccttgtctccggttccaggtcaagaagctccatcaggagaagcagctaggcgtgatggtggacaaggacctgggcagcagctacgacggggtcgagctggaggaaatggtccagctggctctgctatgcacgcagtaccacccgtcccaccggcccagaatgtccgaggtgatcaggatgctggaaggcgagcccgggctcgcggagagatgggaagcgtcgcagggcaacgtggacacgccgaagtccgtctcgtcggagctcctgcctcccaagtacgtggatttcgccgccgcggacgagtcctcgcttggcctggaagccatggagctgtccgggccaaggtga

SEQ ID NO: 240 - DNA, 4769 bp, Zea mays
acgctacgcccccagccgggtaatataccatggccaccaccaccactacccacgccctcgccgccgccccgctcgcgctacacttcgcttccccagtctcccctcccccgctcactatggcgtccacaccgcggctcgctcgcctcgccgcagccgtcgcggcgtggatgctagccgctgctgcttctgctggtgtggaggccggggatccgccgctttcgcccaaggggctcaactacgaaggtgcgccgcgtgccgtgactggggtttccgtgtggaaagttagggtttggtgacttggggtttctgatgctgttcttggcgcggttttgcttcgcttgtgcggttgtgcccgtgcagtggcggcgctcatggcggttaagagccggctgcgggacgagaggggggtcatggccctctgggacatcaactccgtcgacccctgcacctggtccatggtcgcctgctccccggacaagttcgtcgtctcgctgtgagtgagctctctaccgtctctgatcccggccccttattcccatccgtggctgtttgttgcgggtcaatgacagtgttttgtctcgtttcgtttcgcaccggagctgcagccagatggccaacaacggcctgtccgggacgctgtcgccgagcatcgggagcctcagccacctccagacaatgtgagcgtttcagggtgacaacccacctttccattacggttgcctcttgtttgtttcattcctataacttcaccacagtaacatcgcttgcctcacgttcacaaaaccgtaaaacagacatgcatatgcattctatttgaactggttcaagaatgggattgtcaataacactagggaagatgaatggcgatgtttggtctgttcagttggcccagctcccatttagtctagtccaaccgtgatagatgtgttgccaccatgtcacttgcagtcttgcagagcagtgaaggaacattgcaataacactcttggtttgtcattaatttgaatgaaaatcctacagatggtccgcgtaccacttataagcctagaccatcaatcttccagagtcaggacaacttagcaaaatatgatagtctacaatactcttataagagaccatggtccatagaaaccaaaaatcacagcctttattgaaagctcttctttttataactttttattgccaaaaaggcaggtttgggtgcccccagttctaatcacacggaagcaaatagaacccactttcttgccattgacatttgacaatgtcaggatggctagagtttccatcagcgtgttctcgactttctatggcctcttgaaaacagattgtccatttgtatacaaatattgatgctgtgttgcatagctcctaactatatatgtgttgttttctgattttctgaatccaggctgagttgtttgtgcaattgcctggctggatttgtcataatatgtaggtttcaaagttttgcagggaagatgatttgtgtcttcttcttttttgttacctaacattaagcggttgcttgaatcaagttacataaagctagctatttttcctcttttcatgataatttcaattatagcattcctttcttataaccttatttaaccatgaatcgttggtttattctttatagcgtgcgcgcgcgcgcagaagtctcttcttggttttgcgtgattagtcatccaactcgaaaataatgctgcaccattcatccatcttaaaaagctaacagcattggctactggatgatttcctaactgtaatgagtcttctcaattctggacttgtatcgtatttcctgtgggatttcactaattatgactgccattcattcttgtgaaatgggatggtacctgtgttcaatagctgaccttattgttggtttgattcaggtcactacagaataacagaatatcaggtgaaattcctccagagatagggaagctgatcaatctgaatgctcttgacctttccagtaatgagttcattggtgatatcccaagttcattggggcacctgactcgactaaattatctgtgagttgatttcagaaatgtttctaagtttacaacatgtattttgtattaaaactattgctttgtcaatctctcagacgccttgataggaataacttgtctgggccgatcccaacagatgttgctaggcttccaggtctcacattcctgtatgtttcttttctgattttctttctgtttttcacataagtgagctgtaactattgtctacttgactttaaacttacgaggtgatatgtttcagtgacttgtcattcaacaatttaagtggcccagttccaaaaatctatgcacatgattacaggtaacttttggggtgtatgtataagctcttatttctctttttaagcatattttggtgaagcacctagattagcgagaccatgaacacaggacactaggagatgaccgttgtatccatgttgttaatttctatagggaataatgtatggaatgatttgtgggttgtttattagaagatgatgaagaaagggagtgagaataaataaaggagagaaagggtaatctgcatatgtgttgtatatgtctaagtaagtttacaaattctataggccatgtgcttttgaaatggatagagtactgctttactccattttctcatccaaaatcctttgtcagttgcaatgaatgattatttgctccccacctttctgacaatgaagttttcttgttgcattgcttaagctgagactgaccacacacatttttttctgatagttttgacatttcactgaagataacttcttttacttttttcagtcttgcgggaaatcgattcctttgcaattcctcagttatacatggttgttcagatgtgacagcaatgactaatggtaattgctttcccagatggcatatcttttacatatctattctttagaaaccggaacttaactttacattaatggcagggacaatgtcgagacaggtccaaaaggccaagaaccaccatcaattagctttggcaatttctctaagtgtcacctgttccacaatattagttttgttgttcgtgtattggctaagttattgcagatggcgcttgccttttgcttcagctggtaattatccaagcctttgcagtattagctctttacaagttaaatatacacgatctgactttttttatctgtagatcaagatctagaattcgaattgggccatgtgaagcattttgcttttcacgatctgcaaagtgcaacggacaattttaattccaagaatatattaggtcaaggaggttttggtattgtgtataaaggctgtttgagaaatggaactttagtggcagtgaagagattaaaagatcctgatgttaccggtgaagtccagtttcagacagaagttgagttgattggccttgctgtgcacaggaatctcttgcgtttgtatggattttgcatgacctctaaagaacggttgcttgtatatccatatatgccaaatggcagtgttgctgaccgtttgagaggtaactcaattgtctacaacattttaatgttagttaagtttacaattggcattccgcgcaagtctttttcattccttgtaaatatattgtttaagactatgtgttttggttggttctttgccacgtcatattatctgcttatatccttataccttagtaatatatggggttgcaattttcagattatcgcaatggaaaaccatctcttgattggagtaaacgcatgcggattgctcttggtgctgccagggggttactctaccttcatgaacaatgcaatcctaagatcatccacagggacgtcaaagctgcaaacatattgctcgatggaaatttcgaagcaatcgtcggggattttggattggcgaaacttcttgaccgtcaggaatcgcatgttactactgcagttcggggcactattgggcatattgctcccgagtatctctcaactggacagtcctcggaaaagactgatgtttatgggtttggcattctcctgttggaactgattactggtcctaaaaccttgagcaatggacatggccagtctcagaaaggcatgattctagactgggtaagcttctgtgcacttatttacgtactgtttactgtatttcagccccacgctggagagatttaacacctgctttcgttcctattcaggttagagagctaaaggaggacaagagaccggataagctggtcgacagggatctcagagattcatttgatattcttgagctggagtgttcagttgacgtgatcatccaatgcacgcagacgaaccctatgctgcggcctaagatgtccgaaattctgcacgctcttgaagccaatgtcacgctggcggaaaccagcgtcgagttgaacagggaacctcttccttatggtgtgcctcgcagtttctctgtgaggcatgaggacccccacgattcgtcgtccttcataatagagccaattgagctatctggtcccagatgacagctgttgtcagtgtggttgaggcgaaaagaaaagaaagcatggaaacaatacaattgtacaaaacatgtatatcgtggatgtagttcaacttagcaagagtttgctgggcgtgttgccataccttacataatattttgaacgtggagctggagcgaaccttgttggctatttttgttgcttacgttttcatctgccatccatgaggcactgaggcggtcatgcatttttgccgaaaattttccgccaga

SEQ ID NO: 241 - DNA, 3195 bp, Zea mays; identical to SEQ ID NO: 78

SEQ ID NO: 242 - DNA, 3300 bp, Zea mays
atgtcgctccccaccagacttgtgctgctgcttccgttgctgctgcttcatgggatcctaccagcaccaacttcggcgtcagcagcaccgttgagaagtgagacggaccgggaagccttgctggagctgaaggccgtcctaggccagcgatcaagcaggctgtcgtcctggaacagtagcgctagcctgtgcctgtggccaggtgtgacatgcagccacaggcacggaggcagggtctcagcactccatctcagctctgccggccttgccggcaccatacctgcgtcggtgggcaacttgacgttcctgacgagcatcgacctcagccaaaacaagctggaaggcgaaatccccgcggcagttggccgcctgcaccggctgcgataccttgacatgtcaaacaactcgctgcagagcgagatcccggctggcctgaggaactgcagcagccttgtgagcatcaggcttggtgggaaccagctgacgggaggagtccctggttggcttggaggcctgccaaagctccaaggcgtgctgctggggccgaacaatctcacggggctgatcccccggtcgctcgccaatctcacttcttccctgagggaaatcaaccttgagaccaaccacctggctcgagggcaccatccccgagggcttcggtagaatccatggactcgagtcgttcacagtggcaggaaaccgtatctcaggcgccatccccgcggacctctcctcaacgtgtcttcgctgatcacgctcgcggtgtccgacaacacgatgcacggtacgctgccgtctgacatgggggctggcctacccatgatcagatatctcctcctgagcaggaacctcttcgctggaggagttccgccttcacttggcaatgcaaccatgctccatgtgatagatctcagcgtgaacagcctcaccggcaccataccgccaggggtaggaaggctttgtccagataccttagctttcgacgacaacatgcttgaggcaagcagcgcccaggactgggagttcatcacatccttcacgaactgcacccgcggcctgcgtctcctcagcctccagtacaacttgcttggcggtgagctcccgagttccgtcgccaatctttcgtcccagctccagttgctgtacctctcagcgaatgagatttctggtaagataccactcgacattggcaatctagctggcctacaagcactgaagctagactacaaccagttctctgggtctcttcctactagcatcggaaggctatcaaccctgaaactcttgcagttctcgaacaacaacctatcaggaagcctgccttcttcgatcggcaacctaacacaactgcaaatattgctcgcatataagaacgcctttgtagggccccttccatccagccttggcaacttgcaacagctaaatggtgttggcttgtctaataacaagtttactggccctttgcctaaagagattttcaacctgtcgtccttgacagatgatctttatttgtcctacaattacttcgttggttctctcccaccagaagttggaagtcttacaaaccttgtacatctgtacatctccgggaacaatttatctggccccttgcctgattcactaggcaactgcttaagcatgatggagcttcgattggacggtaactccttcagtggtgccattcccacatccttcagttcaatgcgtggcttggtactgctaaatttaacagacaacatgctctcaggaaaaattcctcaagaactgtcccgcataagtggtttagaagaactgtatcttgcccacaacaacctttcaggaccaatccctcatacctttggaaatatgacctcattgaaccatctagacctgtctttcaaccaactcagtggccaaatcccagtacagggtgtgtttactaatgtgacgggcttctcttttgctggtaatgatgaactctgcggaggtgtccaggagttgcatttgcctgcttgcgcaaacaaacctttgtggcacagtcggagaaatcaccatatcattcttaaagtagtgattccagttgcaggtgcactgctgttattcatgaccttagcagttcttgttcgaaccttgcaaaagaaatcaaaagcacaatcagaagctgcaccggtgacagtagagggtgctctccaattgatggacgacgtgtatccaagagtttcctatgcagatttagtacgtggaacagatggattttctctaagcaaccggattggtacagggaggtatggatcggtgtacaaggggagcttggtgatcaataacgcaacaactatcgttgctgtgaaggtttttgatctccaacagtcaggctctttgagaagtttcatgtcagagtgtgaggcacttcgtaaggtccggcatcgtaacttggttagtgtcatcacttgttgctctggttatgactccaaccaaaacaacttcaaagccattgtgctagagtacatgactaatgggagccttgacaagtggatacatccagatcaaggtggacagtctacagatccagttggtctgacattaatgcagagattgaacattgctattgacacttgtgacgcgatggactacctgcataatagttgccagccaccgatagttcactgcgacttgaagccaagcaacatccttctcaatgaagactttggtgctcttgttggggactttggaattgcaaagattcttagagactcgacaggcgacccctcgaacatgaactccagaagctccactggcaccgggataaggggaacaatcggatatgttgctccaggtaactttagtccatacttgtattctcttcctgcttgtgcttgagcacctgactgatttgtaaattggcaagcaatggctttttaaaaaatattcctctatgatgcagaatatggggaaggtcaccaagtttccccatgcggagatgtttacagttttggaattctactcctggagttgtttactggaaaggctcctaccaatgacatgtttgcagatggcctgagcttgcagggctacgtccaggctgcattcccagatcatctggtggacattgtagatcctgctattgtagcagcagaagaaaactatgcacatgatgtgcacagcggaaccagcaacggtccacggggacaaaacaacagtgtcatggtatctgttactgggctggcactgttgtgtactaagcaggcaccagcagaaaggatatccatgagaaacgcagccaccgagctgcggaagataagggcccacttcatccgccagtaa

That which is claimed is:

1. A corn plant or plant part thereof comprising at least one mutation in an endogenous Leucine Rich Repeat Receptor Like Protein Kinase (LRR-RLK) gene that encodes an LRR-RLK protein, wherein the LRR-RLK protein comprises
    (a) a sequence having at least 90% sequence identity to any one of the amino acid sequences of SEQ ID NOs: 87-100, wherein each of SEQ ID NOs: 87-100 comprises motifs having
        (i) the sequence of $IX_1HX_2DX_3K$ (SEQ ID NO:118), wherein $X_1$=V, I, or L, $X_2$=R or C and $X_3$=L or V,
        (ii) the sequence of NXLL (SEQ ID NO:119), wherein X=I or V,
        (iii) the sequence of $DFGLAX_1X_2L$ (SEQ ID NO:120) wherein $X_1$ K or R and $X_2$=L, I, or F,
        (iv) the sequence of $DVX_1X_2X_3GX_4X_5LX_6EL$ (SEQ ID NO:122), wherein $X_1$=F or Y, $X_2$=G or S, $X_3$=F, Y or I, $X_4$=I or V, $X_5$=L or V, and $X_6$=L, V or M, and
        (v) the sequence of $X_1X_2X_3X_4GX_5$ (SEQ ID NO:121), wherein $X_1$=S or T, $X_2$=A, G or S, $X_3$=V or I, $X_4$=A or R, $X_5$=T or S; and/or
    (b) a region having the sequence of any one of the amino acid sequences of SEQ ID NOs: 123-154, 156-166, and 168-179;

wherein the at least one mutation results in a substituted amino acid residue of an alanine (A) to a valine (V) located:
    (a) at position 827 with reference to amino acid position numbering of SEQ ID NO:97; or
    (b) at position 844 with reference to amino acid position numbering of SEQ ID NO:98; and
    wherein the corn plant comprising the mutation has a phenotype of increased kernel row number, optionally without substantially decreasing the length of the ear.

2. The corn plant or part thereof of claim 1, wherein the mutated LRR-RLK protein comprises a sequence having at least 90% sequence identity to the amino acid sequence of SEQ ID NO:190 and SEQ ID NO:191.

3. A method for editing a specific site in the genome of a corn plant cell, the method comprising: cleaving, in a site specific manner, a target site within an endogenous LRR-RLK gene in the corn plant cell, the endogenous LRR-RLK gene encoding:
    (a) a sequence having at least 90% sequence identity to any one of the amino acid sequences of SEQ ID NOs: 87-100, wherein each of SEQ ID NOs: 87-100 comprises motifs having:
        (i) the sequence of $IX_1HX_2DX_3K$ (SEQ ID NO:118), wherein $X_1$=V, I, or L, $X_2$=R or C and $X_3$=L or V, (ii) the sequence of NXLL (SEQ ID NO:119), wherein X=I or V,
(iii) the sequence of DFGLAX$_1$X$_2$L (SEQ ID NO:120) wherein X$_1$=K or R and X$_2$=L, I, or F,
(iv) the sequence of DVX$_1$X$_2$X$_3$GX$_4$X$_5$LX$_6$EL (SEQ ID NO:122), wherein X$_1$=F or Y, X$_2$=G or S, X$_3$=F, Y or I, X$_4$=I or V, X$_5$=L or V, and X$_6$=L, V or M, and
(v) the sequence of X$_1$X$_2$X$_3$X$_4$GX$_5$ (SEQ ID NO:121), wherein X$_1$=S or T, X$_2$=A, G or S, X$_3$=V or I, X$_4$=A or R, X$_5$=T or S; and/or
(b) a region having the sequence of any one of the amino acid sequences of SEQ ID NOs: 123-154, 156-166, and 168-179;
wherein the at least one mutation results in a substituted amino acid residue of an alanine (A) to a valine (V) located:
(a) at position 827 with reference to amino acid position numbering of SEQ ID NO:97; or
(b) at position 844 with reference to amino acid position numbering of SEQ ID NO:98,
thereby generating an edit in the endogenous LRR-RLK gene of the corn plant cell and producing a corn plant cell comprising the edit in the endogenous LRR-RLK gene, wherein a corn plant regenerated from the corn plant cell comprising the edit in the endogenous LRR-RLK gene has a phenotype of increased kernel row number, optionally without substantially decreasing the length of the ear.

4. The method of claim 3, wherein the target site encodes a region of the endogenous LRR-RLK gene comprising the sequence of any one of the amino acid sequences of SEQ ID NOs: 123-154, 156-166, and 168-179.

\* \* \* \* \*